US006892139B2

(12) United States Patent
Eisenberg et al.

(10) Patent No.: US 6,892,139 B2
(45) Date of Patent: May 10, 2005

(54) DETERMINING THE FUNCTIONS AND INTERACTIONS OF PROTEINS BY COMPARATIVE ANALYSIS

(75) Inventors: David Eisenberg, Los Angeles, CA (US); Sergio H. Rotstein, Reading, MA (US); Edward M. Marcotte, Austin, TX (US)

(73) Assignee: The Regents of the University of California, Alameda, CA (US)

( * ) Notice: Subject to any disclaimer, the term of this patent is extended or adjusted under 35 U.S.C. 154(b) by 0 days.

(21) Appl. No.: 09/712,363

(22) Filed: Nov. 13, 2000

(65) Prior Publication Data

US 2002/0164588 A1 Nov. 7, 2002

Related U.S. Application Data

(63) Continuation-in-part of application No. PCT/US00/02246, filed on Jan. 28, 2000.

(60) Provisional application No. 60/165,124, filed on Nov. 12, 1999, provisional application No. 60/165,086, filed on Nov. 12, 1999, provisional application No. 60/179,531, filed on Feb. 1, 2000, provisional application No. 60/126,593, filed on Mar. 26, 1999, provisional application No. 60/117,844, filed on Jan. 29, 1999, provisional application No. 60/118,206, filed on Feb. 1, 1999, provisional application No. 60/134,093, filed on May 14, 1999, and provisional application No. 60/134,092, filed on May 14, 1999.

(51) Int. Cl.[7] ........................ G01N 33/48; G01N 33/50; G06F 19/00; C12Q 1/68

(52) U.S. Cl. ................................ 702/19; 702/20; 435/6

(58) Field of Search .......................... 702/19, 20; 435/6

(56) References Cited

U.S. PATENT DOCUMENTS 6,466,874 B1 * 10/2002 Eisenberg et al. ............ 702/19
6,564,151 B1 * 5/2003 Pellegrini et al. ............. 702/19

FOREIGN PATENT DOCUMENTS

WO WO 00/45322 8/2000 ........... G06F/19/00

OTHER PUBLICATIONS

Tatusov, R. L. et al., "Metabolism and evolution of *Haemophilus influenzae* deduced from a whole–genome comparison with *Escherichia coli*", Curr. Biol., vol. 6, pp. 279–291 (1996).*

Philipp, W. J. et al., "An integrated map of the genome of the tubercle bacillus, *Mycobacterium tuberculosis* H37Rv, and comparison with *Mycobacterium leprae*", PNAS, vol. 93, pp. 3132–3137 (1996).*

Koonin, E.V. et al., "Sequence similarity analysis of *Escherichia coli* proteins: Functional and evolutionary implications", PNAS, vol. 92, pp. 11921–11925 (1995).*

Dandekar et al., "Conservation of gene order: a fingerprint of proteins that physically interact", TIBS, vol. 23, pp. 364–328 (Sep. 1998).*

Marcotte, E.M., et al., "*A combined algorithm for genome–wide prediction of protein function,*" NATURE GB, vol. 402, No. 6757 (1999), pp. 83–86.

Pellegrini, M., et al., "*Assigning protein functions by comparative genome analysis: Protein phylogenetic profiles,*" Proc. Natl. Acad. Sci. USA, vol. 96 (1999) pp. 4285–4288.

Enright, A.J., et al., "*Protein Interaction maps for complete genomes based on gene fusion events,*" NATURE, vol. 402 (1999), pp. 86–90.

Tatusov, R.L., et al., "*A Genomic Perspective on Protein Families,*" SCIENCE, vol. 278 (1997), pp. 631–637.

Marcotte, E.M., et al., "*Detecting Protein Function and Protein–Protein Interactions from Genome Sequences,*" SCIENCE, vol. 285 (1999), pp. 751–753.

Eisen, M.B., et al., "*Cluster analysis and display of genome–wide expression patterns,*" Proc. Natl. Acad. Sci. USA, vol. 95 (1998), pp. 14863–14868.

Bork et al., "Predicting Function: From Genes to Genomes and Back", *J. Mol. Biol.,* (1998) 283, 707–725.

Mark A. Ragan et al., "Microbial Genescapes: A Prokarotic View of the Yeast Genome", *Microbial & Comparative Genomics,* vol. 3, No. 4, 1998.

Roman L. Tatusov et al., "Metabolism and evolution of *Haemophilus influenzae* deduced from a whole–genome comparison with *Escherichia coli, " Current Biology,* 1996, vol. 6, No. 3, pp. 279–291.

Stanley Fields et al., "A novel genetic system to detect protein–protein interactions", *Nature,* vol. 340, Jul. 20, 1989, pp. 245–246.

Frederick R. Blattner et al., "The Complete Genome Sequence of *Escherichia coli* K–12," *Science,* vol. 277, Sep. 5, 1997, pp. 1453–1462.

(Continued)

*Primary Examiner*—Jeffrey Fredman
*Assistant Examiner*—Teresa Strzelecka
(74) *Attorney, Agent, or Firm*—Morrison & Foerster LLP

(57) ABSTRACT

The invention provides novel methods for characterizing the function of nucleic acids and polypeptides. The invention provides a novel method for identifying a nucleic acid or a polypeptide sequence that may be a target for a drug. The invention provides a novel method for identifying a nucleic acid or a polypeptide sequence that may be essential for the growth or viability of an organism. The characterization is based on use of methods of the invention comprising algorithms that can identify functional relationships between diverse sets of non-homologous nucleic acid and polypeptide sequences. The invention provides a computer program product, stored on a computer-readable medium, for identifying a nucleic acid or a polypeptide sequence that may be essential for the growth or viability of an organism. The invention provides a computer program product, stored on a computer-readable medium, for identifying a nucleic acid or a polypeptide sequence that may be a target for a drug. The invention provides a computer system, comprising a processor and a computer program product of the invention.

31 Claims, 5 Drawing Sheets

OTHER PUBLICATIONS

Peter D. Karp et al., "EcoCyc: Encyclopedia of *Escherichia coli* genes and metabolism", *Nucleic Acids Research,* 1998, vol. 26, No. 1, pp. 50–53.

Pazos, et al., "Comparative analysis of different method for the detection of specificity regions in protein families," Biocomputing and Emergent Computation, Online, pp. 1–13, 1997, Retrieved from the Internet on Jun. 22, 2000 <URL:http://www.cnb.uam.es/{cnbprot/conf/TD.html.

Corpet et al., "The ProDom database of protein domain families", *Nucleic Acids Research,* 1998, vol. 26, No. 1, pp. 323–326.

Lynn et al., Science (1986) 233(4764):647–649.

* cited by examiner

DETERMINING THE FUNCTIONS AND INTERACTIONS OF PROTEINS BY COMPARATIVE ANALYSIS

RELATED APPLICATIONS

The present application is a continuation-in-part application ("CIP") of Patent Convention Treaty (PCT) International Application Serial No: PCT/US00/02246, filed in the U.S. receiving office on Jan. 28, 2000, and this application claims the benefit of priority under 35 U.S.C. § 119(e) of U.S. Provisional Application Nos. 60/165,124, and 60/165,086, both filed Nov. 12, 1999, and U.S. Provisional Application No. 60/179,531, filed Feb. 1, 2000. International Application Serial No: PCT/US00/02246 claims the benefit of priority under 35 U.S.C. § 119(e) of U.S. Provisional Application Ser. No. 60/117,844, filed Jan. 29, 1999, U.S. Provisional Application Ser. No. 60/118,206, filed Feb. 1, 1999, U.S. Provisional Application Ser. No. 60/126,593, filed Mar. 26, 1999, U.S. Provisional Applications Ser. No. 60/134,093, filed May 14, 1999, and U.S. Provisional Application Ser. No. 60/134,092, filed May 14, 1999. Each of the aforementioned applications is explicitly incorporated herein by reference in their entirety and for all purposes.

TECHNICAL FIELD

This invention generally relates to genetics and microbiology. The invention provides novel methods to identify the function of and relationships between nucleic acid and protein sequences. The method is particularly useful for finding the identifying genes and polypeptides having potential therapeutic relevance in organisms, e.g., microorganisms, such as *Mycobacterium tuberculosis*. The invention also provides *Mycobacterium tuberculosis* genes and polypeptides found by these methods. These genes and polypeptides are useful as potential drug targets.

BACKGROUND

The determination of the functions of and relationships between nucleic acid and protein sequences has traditionally relied on either the study of homology and sequence identity with genes and proteins of known function or, in the absence of informative homology, laborious experimental work The availability of many complete genome sequences has made it possible to develop new strategies for computational determination of protein functions. Several methods have been developed which can predict the general function of proteins by analyzing their functional relationships rather than sequence similarity. Generally, two proteins can be considered functionally related when they form part of the same biochemical pathway or biological process. For example, although malate dehydrogenase is not homologous to pyruvate carboxylase, and the two enzymes do not catalyze the same reaction, they are functionally related because they both catalyze steps of a common biochemical pathway, namely the tricarboxylic acid cycle.

New methods that can establish such functional relationships could provide valuable information on the functions of uncharacterized nucleic acid and protein sequences.

The disease tuberculosis, caused *Mycobacterium tuberculosis* (MTB) is one of the world's leading killers. The World Health Organization estimates that 30 million deaths from pulmonary tuberculosis will occur during this decade. Alarming reports on the emergence of drug-resistant strains of this bacterium underscore the importance of the search for new therapeutic agents. Identifying the function of every protein produced by MTB will provide researchers with promising new targets for anti-tuberculosis drug design.

SUMMARY

The invention provides novel methods for characterizing the function of nucleic acids and polypeptides. The invention provides a novel method for identifying a nucleic acid or a polypeptide sequence that may be a target for a drug. The invention provides a novel method for identify a nucleic acid or a polypeptide sequence that may be essential for the growth or viability of an organism. The characterization is based on use of methods of the invention comprising algorithms that can identify functional relationships between diverse sets of non-homologous nucleic acid and polypeptide sequences. Characterization of nucleic acid and protein sequences can be the basis for the development of compositions that can interact with those nucleic acids and polypeptides. For example, such characterization can provide a basis for screening methods. Such characterization may allow use of these sequences as targets for drug discovery. Discovery of such compositions can provide the basis for the design of novel drugs, particularly if the characterized sequences are derived from a pathogen.

The invention provides a method for identifying a nucleic acid or a polypeptide sequence that may be a target for a drug comprising the following steps: (a) providing a first nucleic acid or a polypeptide sequence that is known to be a drug target; (b) providing at least one algorithm selected from the group consisting of a "domain fusion" method, a "phylogenetic profile" method and a "physiologic linkage" method, wherein the algorithm is capable analyzing a functional relationship between nucleic acid or polypeptide sequences; and, (c) comparing the first nucleic acid or the polypeptide drug target sequence to a plurality of sequences using at least one of the algorithms as set forth in step (b) to identify a second sequence that has a functional relationship to the first sequence, thereby identifying a nucleic acid or a polypeptide sequence that may be a target for a drug.

The invention provides a method for identifying a nucleic acid or a polypeptide sequence that may be essential for the growth or viability of an organism comprising the following steps: (a) providing a first nucleic acid or a polypeptide sequence that is known to be essential for the growth or viability of an organism; (b) providing at least one algorithm capable analyzing a functional relationship between nucleic acid or polypeptide sequences selected from the group consisting of a "domain fusion" method, a "phylogenetic profile" method and a "physiologic linkage" method; and, (c) comparing the first nucleic acid or the polypeptide sequence to a plurality of sequences using at least one of the algorithms as set forth in step (b) to identify a second sequence that has a functional relationship to the first sequence, thereby identifying a nucleic acid or a polypeptide sequence that may be essential for the growth or viability of an organism.

In one aspect of the methods of the invention, the drug is an anti-microbial drug. In another aspect, the first nucleic acid or a polypeptide sequence is derived from a pathogen. The pathogen can be a microorganism, such as *Mycobacterium tuberculosis* (MTB).

The plurality of sequences used to identify a second sequence can comprise a database of the gene sequences of an entire genome of an organism. The plurality of sequences used to identify a second sequence can comprise a database of the gene sequences derived from a pathogen.

In one aspect of the methods of the invention, the "phylogenetic profile" method algorithm comprises (a) obtaining data, comprising a list of proteins from at least two genomes; (b) comparing the list of proteins to form a protein phylogenetic profile for each protein, wherein the protein phylogenetic profile indicates the presence or absence of a protein belonging to a particular protein family in each of the at least two genomes based on homology of the proteins; and (c) grouping the list of proteins based on similar profiles, wherein proteins with similar profiles are indicated to have a functional relationship. The phylogenetic profile can be in the form of a vector, matrix or phylogenetic tree. The "phylogenetic profile" method can further comprise determining the significance of homology between the proteins by computing a probability (p) value threshold. The probability can be set with respect to the value 1/NM, based on the total number of sequence comparisons that are to be performed, wherein N is the number of proteins in the first organism's genome and M in all other genomes. The presence or absence of a protein belonging to a particular protein family in each of the at least two genomes can be determined by calculating an evolutionary distance. The evolutionary distance can be calculated by: (a) aligning two sequences from the list of proteins; (b) determining an evolution probability process by constructing a conditional probability matrix: p(aa→aa'), where aa and aa' are any amino acids, said conditional probability matrix being constructed by converting an amino acid substitution matrix from a log odds matrix to said conditional probability matrix; (c) accounting for an observed alignment of the constructed conditional probability matrix by taking the product of the conditional probabilities for each aligned pair during the alignment of the two sequences, represented by $$P(p) = \prod_n p(aa_n \to aa'_n);$$

and, (d) determining an evolutionary distance α from powers equation $p' = p^{\alpha}(aa \to aa')$, maximizing for P. The conditional probability matrix can be defined by a Markov process with substitution rates, over a fixed time interval. The conversion from an amino acid substitution matrix to a conditional probability matrix can be represented by:

$$P_B(i \to j) = p(j)2 \wedge \frac{BLOSUM62_{ij}}{2},$$

where BLOSUM62 is an amino acid substitution matrix, and P(i→j) is the probability that amino acid i is replaced by amino acid j through point mutations according to BLOSUM62 scores. In one aspect, the Pj's are the abundances of amino acid j and are computed by solving a plurality of linear equations given by the normalization condition that:

$$\sum_i P_B(i \to j) = 1.$$

In alternative aspects of the methods of the invention, the "physiologic linkage" method algorithm identifies proteins and nucleic acids that participate in a common functional pathway; identifies proteins and nucleic acids that participate in the synthesis of a common structural complex; and, identifies proteins and nucleic acids that participate in a common metabolic pathway.

In one aspect of the invention, the "domain fusion" method algorithm comprises (a) aligning a first primary amino acid sequence of multiple distinct non-homologous polypeptides to second primary amino acid sequence of a plurality of proteins; and, (b) for any alignment found between the first primary amino acid sequences of all of such multiple distinct non-homologous polypeptides and at least one protein of the second primary amino acid sequences, outputting an indication identifying the aligned second primary amino acid sequence as an indication of a functional link between the aligned first and second polypeptide sequences. The aligning can be performed by an algorithm selected from the group consisting of a Smith-Waterman algorithm, Needleman-Wunsch algorithm, a BLAST algorithm, a FASTA algorithm, and a PSI-BLAST algorithm. The multiple distinct non-homologous polypeptides can be obtained by translating a nucleic acid sequence from a genome database. The plurality of proteins can have a known function. At least one of the multiple distinct non-homologous polypeptides can have a known function. At least one of the multiple distinct non-homologous polypeptides can have an unknown function. The alignment can be based on the degree of homology of the multiple distinct non-homologous polypeptides to the plurality of proteins. The "domain fusion" method can comprise determining the significance of the aligned and identified second primary amino acid sequence by computing a probability (p) value threshold. The probability threshold can be set with respect to the value 1/NM, based on the total number of sequence comparisons that are to be performed, wherein N is the number of proteins in a first organism's genome and M in all other genomes. The "domain fusion" method can further comprising filtering excessive functional links between one first primary amino acid sequence of multiple distinct non-homologous polypeptides and an excessive number of other distinct non-homologous polypeptides for any alignment found between the first primary amino acid sequences of the distinct non-homologous polypeptides and at least one of the second primary amino acid sequences of the plurality of proteins.

The invention provides a computer program product, stored on a computer-readable medium, for identifying a nucleic acid or a polypeptide sequence that may be a target for a drug, the computer program product comprising instructions for causing a computer system to be capable of: (a) inputting a first nucleic acid or a polypeptide sequence that is known to be a drug target; (b) accessing at least one algorithm capable analyzing a functional relationship between nucleic acid or polypeptide sequences selected from the group consisting of a "domain fusion" method, a "phylogenetic profile" method and a "physiologic linkage" method; and (c) comparing the first nucleic acid or the polypeptide drug target sequence to a plurality of sequences using at least one of the algorithms set forth in step (b) to identify a second sequence that has a functional relationship to the first sequence and generating an output identifing a nucleic acid or a polypeptide sequence that may be a target for a drug .

The invention provides a computer program product, stored on a computer-readable medium, for identifying a nucleic acid or a polypeptide sequence that may be essential for the growth or viability of an organism, the computer program product comprising instructions for causing a computer system to be capable of: (a) providing a first nucleic acid or a polypeptide sequence that is known to be essential for the growth or viability of an organism; (b) accessing at least one algorithm capable analyzing a functional relationship between nucleic acid or polypeptide sequences selected from the group consisting of a "domain fusion" method, a "phylogenetic profile" method and a "physiologic linkage" method; and, (c) comparing the first nucleic acid or the polypeptide sequence to a plurality of sequences using at least one of the algorithms set forth in step (b) to identify a second sequence that has a functional relationship to the first sequence and generating an output identifing a nucleic acid or a polypeptide sequence that may be essential for the growth or viability of an organism.

The invention provides a computer system, comprising: (a) a processor; and, a computer program product of the invention.

All publications, patents, patent applications, GenBank sequences and ATCC deposits, cited herein are hereby expressly incorporated by reference for all purposes.

The details of one or more embodiments of the invention are set forth in the accompanying drawings and the description below. Other features, objects, and advantages of the invention will be apparent from the description and drawings, and from the claims.

DESCRIPTION OF DRAWINGS

Like reference symbols in the various drawings indicate like elements.

DETAILED DESCRIPTION

Figure 1:
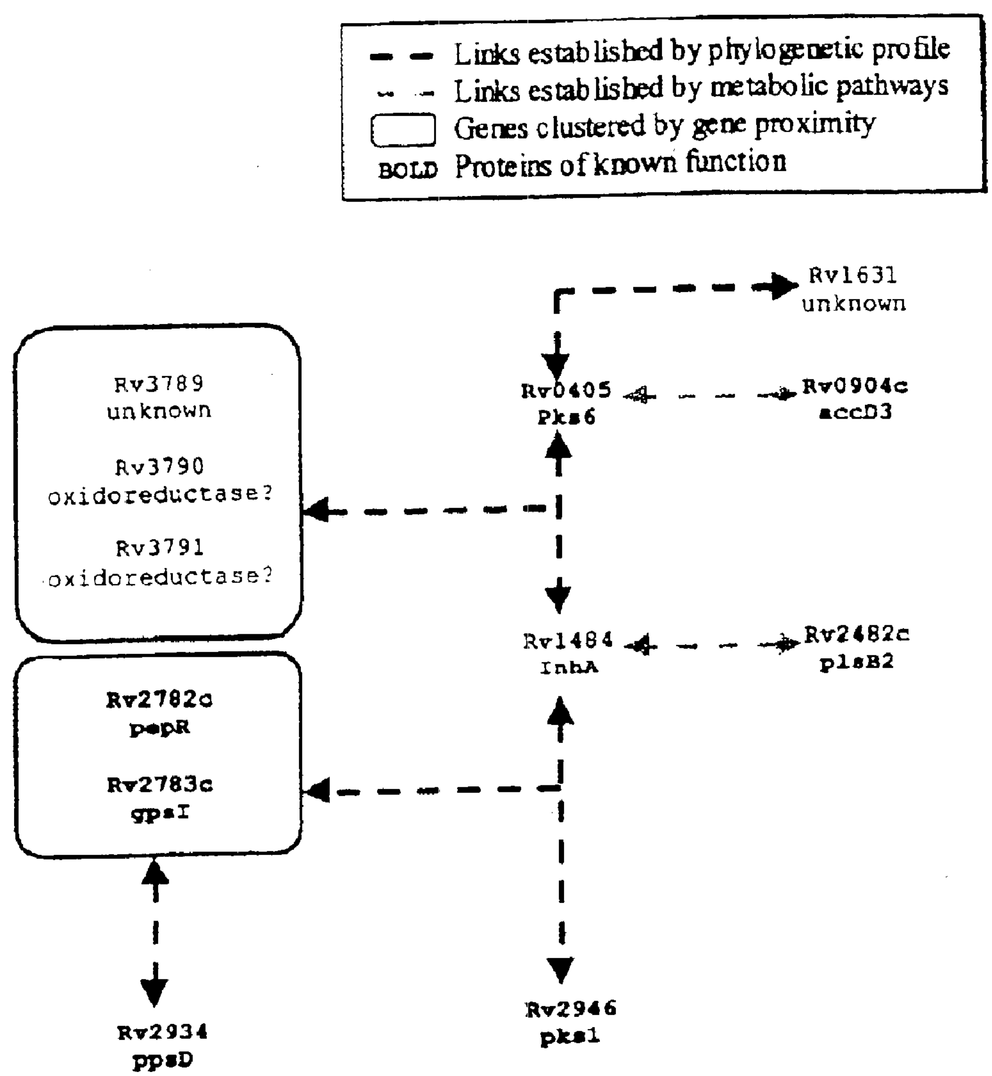
FIG. 1 is an example of functional linkages predicted between InhA (Rv 1484) and other TB genes.
Figure 2:
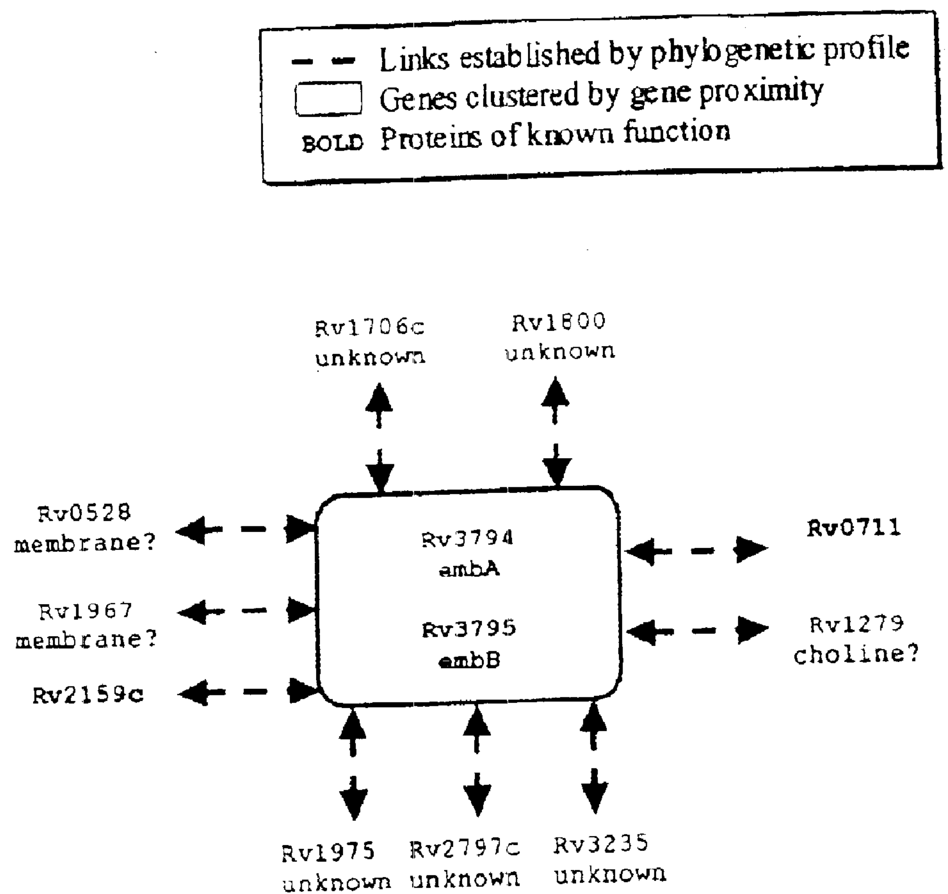
FIG. 2 is an example of predicted functional linkages between embB (Rv 3795), which is a target of the drug ethambutol, and other TB genes using the phylogenetic profile method.

The present invention: provides novel methods for identifying the relationships between and the function of nucleic acid and polypeptide sequences. The methods of the invention identify novel genes and polypeptides on the basis of their functional linkage to other proteins whose biological function or processes is known or inferred by homology.

The genes and polypeptides identified by the methods of the invention can be used in screening methods for the identification of compositions which, by binding or otherwise interacting with the gene or polypeptide, are capable of modifying the physiology and growth of an organism. The compositions identified by these screening methods are useful as drugs and pharmaceuticals. Thus, genes and polypeptides identified by the methods of the invention, including the genes and polypeptides identified herein, can be used as potential drug targets.

One aspect of the invention provides methods for identifying the function of genes and polypeptides from *Mycobacterium tuberculosis* (MTB or TB). Based on this new functional determination, these genes and polypeptides can be used to screen for compositions capable of modifying the physiology and growth of *Mycobacterium tuberculosis* (TB). Thus, genes and polypeptides identified by the methods of the invention, including the genes and polypeptides identified herein, can be used as targets in screening protocols and can be useful as potential drug targets.

The function of the TB genes and polypeptides of the present invention were identified using the methods of the invention; i.e., they were identified on the basis of their functional linkage to other proteins whose biological function or processes were known by experiment or inferred by homology. TB genes and polypeptides that are functionally linked to genes known to be involved in pathogenesis or organisms survival are potential drug targets. Genes or polypeptides associated with TB pathogenesis, survival or that are important or unique to TB biochemical pathways are potential drug targets. TB genes and polypeptides that have no homologues identified in humans are potential drug targets. The function of many of the TB genes and polypeptides identified is based on the genes or polypeptides with which they are functionally linked.

TB genes whose function was identified using the methods of the invention are effectively targeted by a drug (i.e., they can act as *bona fide* drug targets) provides proof of principle that the invention's methods for identifying functionally linked genes can identify TB genes and polypeptides that are drug targets. Further confirmation that the genes identified by the methods of the invention include *bona fide* drug targets can be supported by the fact that genes already known to be targets for drugs have been independently identified, or "re-discovered," by the invention's methods.

The novel TB genes described herein are identified as being functionally related or linked to other genes, including other TB genes, such as a known TB drug target (e.g., InhA polypeptide, which is a target of isoniazid). These functional linkages are established using mathematical algorithms. The assignment or inference of a function to TB genes and polypeptides based on their linkage or relatedness to other genes and polypeptides is described in U.S. provisional application Ser. No. 60/165,086. Potential TB drug targets are identified by several methods discussed herein and in further detail in U.S. provisional application Ser. No. 60/134,092. Through the use of these methods, TB genes and polypeptides have been identified as potential drug targets and are illustrated on Tables 1 and 2, and FIGS. 1 to 5. The nucleotide and amino acid sequences of these potential drug targets are illustrated on Tables 3 and 4, respectively (see below).

The phrase "functional link," "functionally related" and grammatical variations thereof, when used in reference to genes or polypeptides, means that the genes or polypeptides are predicted to be linked or related. A particular example of functionally related or linked proteins is where two proteins participate in a biochemical or metabolic pathway (e.g., malate dehydrogenase and fumarase, which are both present in the TCA cycle). Thus, although functionally linked or related proteins may not have sequence homology to each other, they are linked by virtue of their participation in the same biochemical pathway. Other examples of linked or related polypeptides are where two polypeptides are part of a protein complex, physically interact, or act upon each another.

The "domain fusion" or "Rosetta Stone" method searches protein sequences across all known genomes and identifies proteins that are separate in one organism but joined as intramolecular domains into one larger protein in another organism. Such proteins that are separate in some organisms but joined in others often carry out related or sequential functions and are therefore functionally linked.

The phylogenetic profile method compares protein sequences across all known genomes and analyzes the pattern of inheritance of each protein across the different organisms. Proteins that have similar patterns of inheritance, either acquired or lost as a part of a group of proteins through evolution, are functionally linked. The gene proximity method identifies genes that remain physically close or "clustered" throughout evolution and are therefore functionally linked.

A particular example of the identification of a potential TB drug target would be to identify a TB gene or polypeptide functionally linked to a known drug target. Anti-TB drugs include isoniazid, rifampicin, ethambutol, streptomycin, pyrazxinamide, and thiacetazone. For isoniazid, this drug is believed to act through enoyl-acyl reductase InhA, resulting in mycolic acid biosynthesis inhibition. Thus, TB genes or polypeptides functionally linked to enoyl-acyl reductase InhA are potential drug targets; see FIG. 1, which shows an analysis of InhA, the target for isoniazid, the most widely used anti-tuberculosis drug, and functional linkages to a set of genes mostly known or hypothesized to be involved in cell wall-related processes and lipid and polyketide metabolism. Particular examples of the identification of several TB genes and polypeptides that are functionally related to the target of these anti-TB drugs is shown in FIGS. 1 to 5.

"Domain Fusion" or "Rosetta Stone" Method

The "domain fusion" or "Rosetta Stone" method compares protein sequences across known nucleic acid databases (e.g., known genomes) to identify genes and proteins that are separate entities in one organism but are joined into one larger multidomain protein in another organism. In such cases, the two separate proteins often carry out related or sequential functions or form part of a larger protein complex. Therefore, the general function of one component (e.g., one or more of the unknown proteins) can be inferred from the known function of the other component. In addition, merely identifying links between proteins using the method described herein provides valuable information (e.g., usefulness as a target for an antibacterial drug), regardless of whether the function of one or more of the proteins used to form the link(s) is known. Because the two components do not have similar amino acid sequence the function of one could not be inferred from the other on the basis of sequence similarity alone.

The methods for identifying drug targets (e.g., TB drug targets) described herein (e.g., the "Rosetta Stone Method") are based on the idea that proteins that participate in a common structural complex, metabolic pathway, biological process or with closely related physiological functions, are functionally linked. In addition, these methods also are capable of identifying proteins that interact physically with one another. Functionally linked proteins in one organism can often be found fused into a single polypeptide chain in a different organism. Similarly, fused proteins in one organism can be found as individual proteins in other organisms. For example, in a first organism one might identify two un-linked proteins "A" and "B" with unknown function. In another organism, one may find a single protein "AB" with a part that resembles "A" and a part that resembles "B". Protein AB allows one to predict that "A" and "B" are functionally related.

The functional activity of each distinct protein in the "Rosetta Stone" method need not be known prior to performing the method (ie., the function of A, B, or AB need not be known). Using the "Rosetta Stone" method to compare and analyze several unknown protein sequences can provide information regarding relationships of each protein absent knowledge about the functional activity of the initially analyzed proteins themselves. For example, the information (i.e., the links) can provide information that the proteins are part of a common pathway, function in a related process or physically interact. Such information need not be based on the biological function of the individual proteins.

These methods can provide information regarding links between previously un-linked proteins that function, for example, in a concerted process. A marker, for example, for a particular disease state is identified by the presence or absence of a protein (e.g., Her2/neu in breast cancer detection). Links (i.e., information) identified by the method, which link proteins "B" and "C" to such a marker suggest that proteins "B" and "C" are related by function, physical interaction or part of a common biological pathway with the marker. Such information is useful in designing screening methods and identifying drug targets (e.g., TB drug targets), making diagnostics, and designing therapeutics.

In one approach, the "Rosetta Stone" method is performed by sequence comparison that searches for incomplete "triangle relationships" between, for example, three proteins, i.e., for two proteins A' and B' that are different from one another but similar in sequence to another protein AB. Completing the triangle relationship provides useful information regarding the proteins' biological function(s), functional interaction, pathway relationships or physical relationships with other proteins in the "triangle."

Either nucleotide sequences or amino acid sequences can be used in the methods for identifying functionally related or linked genes or polypeptides. Where a nucleic sequence is to be used it can be first translated from a nucleic acid sequence to amino acid sequence. Such translation may be performed in all frames if the coding sequence is not known. Programs that can translate a nucleic acid sequence are known in the art. In addition, for simplicity, the description of this method discusses the use of a "pair" of proteins in the determination of a "Rosetta Stone" protein, more than 2 may be used (e.g., 3, 4, 5, 10, 100 or more proteins). Accordingly, one can analyze chains of linked proteins, such as "A" linked by a Rosetta Stone protein to "B" linked by a Rosetta Stone protein to "C", etc. By this method, groups of functionally related proteins can be found and their function identified.

A method can start with identifying the primary amino acid sequence for a plurality of proteins whose functional relationship is to be determined (e.g., protein A' and protein B'). A number of source databases are available, as described above, that contain either a nucleic acid sequence and/or a deduced amino acid sequence for use with the first step. The plurality of sequences (the "probe sequences") are then used to search a sequence database, e.g., GenBank (NCBI, NLM, NIH), PFAM (a large collection of multiple sequence alignments and hidden Markov models covering many common protein domains; Washington University, St. Louis Mo.) or ProDom (a database based on recursive PSI-BLAST searches and designed as a tool to help analyze domain arrangements of proteins and protein families, see, e.g., Corpet (1999) Nucleic Acids Res. 27:263–267), either simultaneously or individually. Every protein in the sequence database is examined for its ability to act as a "Rosetta Stone" protein (i.e., a single protein containing polypeptide sequences or domains from both protein A' and protein B'). A number of different methods of performing such sequence searches are known in the art. Such sequence alignment methods include, for example, BLAST (see, e.g., Altschul (1990) J. Mol. Biol. 215: 403–410), BLITZ (MPsrch) (see, e.g., Brenner (1995) Trends Genet. 11:330–331; and infra), and FASTA (see, e.g., Pearson (1988) Proc. Natl. Acad. Sci. USA 85(8):2444–2448; and infra).

The probe sequence can be any length (e.g., about 50 amino acid residues to about 1000 amino acid residues).

Probe sequences (e.g., polypeptide sequences or domains) found in a single protein (e.g., an "AB" multidomain protein) are defined as being "linked" by that protein.

Where the probe sequences are used individually to search the sequence database, one can mask those segments having homology to the first probe sequence found in the proteins of the sequence database prior to searching with the subsequent probe sequence. In this way, one eliminates any potential overlapping sequences between the two or more probe sequences.

The linked proteins can then be further compared for similarity with one another by amino acid sequence comparison. Where the sequences are identical or have high homology, such a finding can be indicative of the formation of homo-dimers, -trimers, etc. Typically, "Rosetta Stone"-linked proteins are only kept when the linked proteins show no homology to one another (e.g., hetero-dimers, trimers, etc.).

In another method for identifying functional linkages, a potential fusion protein lacking any functional information that is suspected of having two or more domains (e.g., a potential "Rosetta Stone" protein) may be used to search for related proteins. In this method, the primary amino acid of the fusion protein is determined and used as a probe sequence. This probe sequence is used to search a sequence database (e.g., GenBank, PFAM or ProDom). Every protein in the sequence database is examined for homology to the potential fusion protein (i.e., multiple proteins containing polypeptide sequences or domains from the potential fusion protein). A number of different methods of performing such sequence searches are known in the art, e.g., BLAST, BLITZ (Biocomputing Research Unit, University of Edinburgh, Scotland, the "MPsrch program" performs comparisons of protein sequences against the Swiss-Prot protein sequence database using the Smith and Waterman best local similarity algorithm), and FASTA.

Probe sequences found in more than one protein (e.g., A' and B' proteins) are defined as being "linked" so long as at least one protein per domain containing that domain but not the other is also identified. In other words, at least one protein or domain of the plurality of proteins must also be found alone in the sequence database. This verifies that the protein or domain is not an integral part of a first protein but rather a second independent protein having its own functional characteristics.

Statistical methods can be used to judge the significance of possible matches. The statistical significance of an alignment score is described by the probability, P, of obtaining a higher score when the sequences are shuffled. One way to compute a P value threshold is to first consider the total number of sequence comparisons that are to be performed. For example, if there are N proteins in *E. coli* and Min all other genomes this number is N×M. If a comparison of this number of random sequence would result in one pair to yield a P value of 1/NM by chance this then is set as the threshold.

This method provides information regarding which proteins are functionally related (e.g., related biological functions common structural complexes, metabolic pathways or biological process) a subset of which physically interact in an organism.

Alignment Algorithms

To align sequences, a number of different procedures can be used that produce a good match between the corresponding residues in the sequences. Typically, the Smith-Waterman (Smith (1981) Adv. Appl. Math. 2:482) or Needleman-Wunsch algorithm (Needleman (1970) J. Mol. Biol. 48:443) algorithm, are used, however, other, faster procedures such as BLAST, FASTA, PSI-BLAST (a version of Blast for finding protein families), or others known in the art (see infra discussion), can be used.

Filtering Methods

The Rosetta Stone Method provides at least two pieces of information. First the method provides information regarding which proteins are functionally related. Second the method provides information regarding which proteins are physically related. Each of these two pieces of information has different sources of error and prediction. The first type of error is introduced by protein sequences that occur in many different proteins and paired with many other protein sequences. The second type of error is introduced due to there often being multiple copies of similar proteins, called paralogs, in a single organism. In general, the "Rosetta Stone" method predicts functionally related proteins well, with no filtering of results required. However, it is possible to filter the error associated with either the first or second type of information.

The invention recognizes that a few domains are linked to an excessive number of other domains by a "Rosetta Stone" protein. For example, 95% of the domains are linked to fewer than 25 other domains. However, some domains, e.g., the Src Homology 3 (SH3) domain or ATP-binding cassette (ABC domains), link to more than a hundred other domains. These links were filtered by removing all links generated involving these 5% of domains (ie., the domains linked to more than 25 other domains). For example, in *E. coli*, without filtering, 3531 links were identified using the domain-based analysis, but after filtering only 749 links were identified. This method improved prediction of functionally related proteins by 28% and physically related proteins by 47%. Accordingly, there are a number of ways to filter the results to improve the significance of the functional links. As described above, as the number of functional links increases there is an increased higher chance of finding a "Rosetta Stone" protein. By reducing the excessively linked proteins one reduces the chance number of "Rosetta Stone" proteins thereby increasing the significance of a functional link.

Error introduced by multiple paralogs of linked proteins should have little effect on functional prediction, as paralogs usually have very similar function, but will affect the reliability of prediction of protein-protein interactions. This estimate is calculated for each linked protein pair, and can be estimated roughly as:

$$\text{Fractional Error} = 1 - \frac{\sqrt{N}}{N},$$

where N is the number of paralogous protein pairs, (e.g., A linked to B, A' linked to B', A linked to B', and A' linked to B, in the case that A and A' are paralogs, as are B and B', and the linking proteins is AB as above).

The error can also be estimated as 1-T, where T is the mean percent of potential true positives calculated for all domain pairs in an organism. For each domain pair linked by a Rosetta Stone protein, there are n proteins with the first domain but not the second, and m proteins with the second domain but not the first. The percent of true positives T is therefore estimated as the smaller of n or m divided by n times m. As this error T can be calculated for each set of linked domains, it can describe the confidence in any particular predicted interaction.

In addition, the error in functional links can be caused by small conserved regions or repeated common amino acid sequences being repeatedly identified in a "Rosetta Stone"

protein by a plurality of distinct non-homologous polypeptides. To reduce this error the percent of identity between the "Rosetta Stone" and the distinct non-homologous polypeptide can be measured. Alignment percentages of about 50% to about 90%, or, alternatively, about 75%, between the "Rosetta Stone" and the distinct polypeptide are indicative of links that are not subject to the small peptide sequence.

Phylogenetic Pathway Method

The "phylogenctic profile" method compares protein sequences across all known genomes and analyzes the pattern of inheritance of each protein across the different organisms. In its simplest form, each protein is simply characterized by its presence or absence in each organism. For example, if there are 16 known genomes, then each protein may be assigned a 16-bit code or phylogenetic profile. Since proteins that function together (e.g., in the same metabolic pathway or as part of a larger functional or structural complex) evolve in a correlated fashion, they should have the same or similar patterns of inheritance, and therefore similar phylogenetic profiles. Therefore, the function of one protein may be inferred from the function of another protein, which has a similar profile, if its function is known. As with the Rosetta Stone method, the function of one protein is inferred from the function of another protein which is dissimilar in sequence. Furthermore, the predicted link between the proteins has utility in developing, for example, drug targets, diagnostics and therapeutics.

The phylogenetic profile method can be implemented in a binary code (i.e., describing the presence or absence of a given protein in an organism) or a continuous code that describes how similar the related sequences are in the different genomes. In addition, grouping of similar protein profiles may be made wherein similar profiles are indicative of functionally related proteins. Furthermore, the requirements for similarity can be modified depending upon particular criteria by varying the difference in similar bit requirements. For example, criteria requiring that the degree of similarity in the profile include all 16 bits being identical can be set, but may be modified so that similarity in 15 bits of the 16 bits would indicate relatedness of the protein profiles as well. Statistical methods can be used to determine how similar two patterns must be in order to be related.

The phylogenetic profile method is applicable to any genome including, e.g., viral, bacterial, archaeal or eukaryotic. The method of phylogenetic profile grouping provides the prediction of function for a previously uncharacterized protein(s). The method also allows prediction of new functional roles for characterized proteins based upon functional linkages. It also provides potential informative connections (i.e., links) between uncharacterized proteins.

To represent the subset of organisms that contain a homolog a phylogenetic profile is constructed for each protein. The simplest manner to represent a protein's phylogenetic history is via a binary phylogenetic profile for each protein. This profile is a string with N entries, each one bit, where N corresponds to the number of genomes. The number of genomes can be any number of two or more (e.g., 2, 3, 4, 5, 10, 100, to 1000 or more). The presence of a homolog to a given protein in the nth genome is indicated with an entry of unity at the $n^{th}$ position (e.g., in a binary system an entry of 1). If no homolog is found the entry is zero. Proteins are clustered according to the similarity of their phylogenetic profiles. Similar profiles show a correlated pattern of inheritance, and by implication, functional linkage. The method predicts that the functions of uncharacterized proteins are likely to be similar to characterized proteins within a cluster.

In order to decide whether a genome contains a protein related to another particular protein, the query amino acid sequence is aligned with each of the proteins from the genome(s) in question using known alignment algorithm (see above). To determine the statistical significance of any alignment score, the probability, p, of obtaining a higher score when the sequences are shuffled is described. One way to compute a p value threshold is to first consider the total number of sequence comparisons that are being aligned. If there are N proteins in a first organism's genome and M in all other genomes this number is N×M. If this number were compared to random sequences it would be expected that one pair would yield a p value of $$\frac{1}{NM}.$$

This value can be set as a threshold. Other thresholds may be used and will be recognized by those of skill in the art.

A non-binary phylogenetic profile can be used. In this method, the phylogenetic profile is a string of N entries where the $n^{th}$ entry represents the evolutionary distance of the query protein to the homolog in the $n^{th}$ genome. To define an evolutionary distance between two sequences an alignment between two sequences is performed. Such alignments can be carried out by any number of algorithms known in the art (for examples, see those described above). The evolution is represented by a Markov process with substitution rates, over a fixed interval of time, given by a conditional probability matrix:

$$p(aa \rightarrow aa')$$

where aa and aa' are any amino acids. One way to construct such a matrix is to convert the BLOSUM62 amino acid substitutions matrix (or any other amino acid substitution matrix, e.g., PAM100, PAM250) from a log odds matrix to a conditional probability (or transition) matrix:

$$P_B(i \rightarrow j) = p(j)2\frac{BLOSUM62_{ij}}{2}. \tag{1}$$

$P(i \rightarrow j)$ is the probability that amino acid i will be replaced by amino acid j through point mutations according to the BLOSUM62 scores. The $p_j$'s are the abundances of amino acid j and are computed by solving the 20 linear equations given by the normalization conditions that:

$$\sum_i P_B(i \rightarrow j) = 1. \tag{2}$$

The probability of this process is computed to account for the observed alignment by taking the product of the conditional probabilities for each aligned pair:

$$P(p) = \prod_n p(aa_n \rightarrow aa'_n). \tag{3}$$

A family of evolutionary models is then tested by taking powers of the conditional probability matrix: $p' = p^{\alpha}(aa \rightarrow aa')$. The power $\alpha$ that maximized P is defined to be the evolutionary distance.

Many other schemes may be imagined to deduce the evolutionary distance between two sequences. For example, one might simply count the number of positions in the sequence where the two proteins have adapted different amino acids.

Although the phylogenetic history of an organism can be presented as a vector (as described above), the phylogenetic profiles need not be vectors, but may be represented by matrices. This matrix includes all the pair wise distances between a group of homologous protein, each one from a different organism. Similarly, phylogenetic profiles could be represented as evolutionary trees of homologous proteins. Functional proteins could then be clustered or grouped by matching similar trees, rather than vectors or matrices.

In order to predict function, different proteins are grouped or clustered according to the similarity of their phylogenetic profiles. Similar profiles indicate a correlated pattern of inheritance, and by implication, functional linkage.

Grouping or clustering may be accomplished in many ways. The simplest is to compute the Euclidean distance between two profiles. Another method is to compute a correlation coefficient to quantify the similarity between two profiles. All profiles within a specified distance of the query profile are considered to be a cluster or group.

Typically a genome database will be used as a source of sequence information. Where the genome database contains only the nucleic acid sequence that sequence is translated to an amino acid sequence in frame (if known) or in all frames if unknown. Direct comparison of the nucleic acid sequences of two or more organisms may be feasible but will likely be more difficult due to the degeneracy of the genetic code. programs capable of translating a nucleic acid sequence are known in the art or easily programmed by those of skill in the art to recognize a codon sequence for each amino acid.

The phylogenetic profile provides an indication of those proteins in each of the at least two organisms that share some degree of homology. Such a comparison can be done by any number of alignment algorithms known in the art or easily developed by one skilled in the art (see, for example, those listed above, e.g., BLAST, FASTA etc.) In addition, thresholds can be set regarding a required degree of homology. Each protein is then grouped at 224 with related proteins that share a similar phylogenetic profile using grouping algorithms.

"Functionally-, Structuraly- or Metabolically- Linked" Method

The "physiologic linkage" method is a computational method that detects (i.e., identifies) proteins, and the genes that encode them, that participate in a common functional pathway (e.g., cell motility or cell division), that participate in the synthesis of the same or a similar structural complex (e.g., a cell wall) or participate in the same or similar metabolic pathway (e.g., glycolysis, lipid synthesis, and the like). Proteins within these common functional pathway groups are examples of "functionally linked" proteins. Having a common functional "goal" they evolve in a correlated fashion. Thus, "homologs" in different organisms can be comparatively identified. While these detection methods are very effective in identifying functional homologues in the same subset of organisms, functional linkages can be made between widely genetically disparate organisms.

In one aspect, metabolic pathways are defined as links between proteins that operate in the same metabolic pathway that can be identified by sequence identity searching, e.g., by performing a BLAST search to find top-scoring polypeptides with high similarity (BLAST alignment E-value<$10^{-20}$) to polypeptides identified in a known pathway. For example, *M. tuberculosis* proteins were so analyzed against *E. coli* proteins; MTB proteins whose *E. coli* homologs (i.e., having high similarity by BLAST alignment) act adjacently in metabolic pathways as defined in the EcoCyc database (see, e.g., Karp (1998) Nucleic Acids Res. 26:50–53) were identified.

In another example, flagellar proteins are found in bacteria that possess flagella but not in other organisms. Accordingly, if two proteins have homologs in the same subset of fully sequenced organisms, they are likely to be functionally linked. The methods of the invention use this concept to systematically map links between all the proteins coded by a genome.

Typically, functionally linked proteins have no amino acid sequence similarity with each other and, therefore, cannot be linked by conventional sequence alignment techniques. Accordingly, the methods of the invention identify drug targets that could not be identified using conventional sequence comparison (i.e., sequence homology or sequence identity) techniques.

Prediction of functionally linked proteins by the "phylogenetic method" can also be used in conjunction with the "domain fusion" or "Rosetta Stone" method and also can be filtered by other methods that predict functionally linked proteins, such as the protein phylogenetic profile method or the analysis of correlated mRNA expression patterns. It was found that filtering by these two methods for the Rosetta Stone prediction for *S. cerevisiae*, that proteins predicted to be functionally linked by two or more of these three methods were as likely to be functionally related as proteins that were observed to physically interact by experimental techniques like yeast 2-hybrid methods or co-immunoprecipitation methods.

For example, a combination of these methods of prediction can be used to establish links between proteins of closely related function. The methods of the invention (i.e., the "Rosetta Stone" method and the "phylogenetic profile" method) can be combined with one another or with other protein prediction methods known in the art; see, for example, Eisen (1998) "Cluster analysis and display of genome-wide expression partners," *Proc. Natl. Acad. Sci. USA*, 95:14863–14868.

The various techniques, methods, and variations thereof described can be implemented in part or in whole using computer-based systems and methods. Additionally, computer-based systems and methods can be used to augment or enhance the functionality described above, increase the speed at which the functions can be performed, and provide additional features and aspects as a part of or in addition to those of the invention described elsewhere in this document. Various computer-based systems, methods, and implementations in accordance with this technology are described herein.

Proteins Linked to Current Drug Targets

The invention also provides a novel method for identifing a polypeptide, or the nucleic acid sequence that encodes it, that is a target for a drug. The method analyzes the functional relationship between at least two sequences, wherein at least one of the sequences is a known target of a drug or encodes a polypeptide drug target. The method comprises identifying proteins, and the genes that encode them, that are functionally linked to the targets of known drugs. The functional linkage is determined by using the "domain fusion" method, the "phylogenetic profile" method or the "physiologic linkage" method, or a combination thereof, as described herein.

Thus, this aspect of the invention provides methods identifying drug targets from among all or a subset of genes in a genome using computationally-determined functional linkages. In one implementation of the method, functional linkages are calculated using the "domain fusion" method, the "phylogenetic profile" method or the "physiologic linkage" method, or a combination thereof, between all "query genome genes." Next, each set of genes predicted to be functionally linked to either a known drug target or to a sequence homolog or ortholog (defined below) to a known drug target are examined. These proteins (and the nucleic acids that encode them) are functionally linked to known drug targets; thus, they are operating in the same pathways or systems targeted by the known drug. Accordingly, the methods of the invention have identified them as drug targets.

This method is particularly effective for identifying drug targets in pathogens, such as microorganisms, e.g., bacteria, viruses and the like. This method allows for the identification of novel drug targets that cannot be identified by other techniques, such as traditional sequence homology or sequence identity comparison techniques. Several known drug targets in *M. tuberculosis* were used with the methods of the invention to use functional linkages to identify potential new drug targets in the same pathways as the known drug targets.

There are very few drugs that are effective for anti-tuberculosis therapy, since the complex lipid-rich mycobacterial cell wall is impermeable to many antibacterial agents. Additionally, single- and multi-drug resistance is rapidly emerging against these drugs. To address this issue, the methods of the invention were used to identify *Mycobacterium tuberculosis* (MTB or TB) proteins that are functionally linked to the targets of known drugs. Inhibiting these proteins should have the same effect on the organism as the drug, since the same processes or pathways would be disrupted. Targeting multiple components of a given biochemical pathway would also diminish the opportunity for the development of resistance because various related proteins would have to mutate against inhibitors while preserving the overall functionality of the pathway.

A list of targets of essential anti-TB drugs (World Health Organization, Geneva, Switzerland) was compiled. The anti-TB drugs included isoniazid, rifampicin, ethambutol, streptomycin, pyrazinarnide and thiacetazone. Although not enough is known about the molecular basis of action of the latter two, the functional linkages of the known drug targets was examined.

Isoniazid. This is one of the most widely used of all anti-tuberculosis drugs. It is believed that the compound is activated by the catalase-peroxidase KatG. Once activated, it then attaches to a nicotinamide adenine dinucleotide bound to the enoyl-acyl carrier protein reductase InhA, resulting in the inhibition of mycolic acid biosynthesis Rozwarski (1998) Science 279:98–102.

Using the "phylogenetic profile, the inhA gene was "linked," or functionally associated with, to two polyketide synthases, pks1 and pks6 (FIG. 1), both of which contain acyl carrier protein motifs. The polyketide synthase pks6 is in turn known from established metabolic pathways to be linked to fatty acid biosynthesis gene accD3. Further, pks6 is linked to fadD28 and to the operon containing the genes ppsA-E, all recently reported to be crucial for bacterial replication in host lungs (see, e.g., Cox (1999) Nature 402:79–83).

The inhA gene was also linked to an operon encoding two putative oxidoreductases and a gene of entirely unknown function. The inhA gene was further linked to a second operon that includes pepR and gpsI. PepR is a protease whose *Bacillus subtilis* homolog is adjacent to the genes coding for enzymes that synthesize diaminopimelate, a component of the cell wall incorporated by the murE gene product and diaminopicolinate (see, e.g., Chen (1993) J. Biol. Chem. 268:9448–9465). PepR is an ortholog of an essential yeast gene and is likely to be essential for MTB (see below). GpsI is a putative multifunctional enzyme involved in guanosine pentaphosphate synthesis and polyribonucleotide nucleotidyltransfer. The high reliability of the predicted functional link between gpsI and pepR and the absence of eukaryotic homologs suggests that gpsI could be a promising target for drug design.

Rifampicin. This compound, along with the related rifabutin and KRM-1648 are believed to act by directly targeting the RNA polymerase β-subunit (rpoB) given that 96% of resistant isolates were found to have mutations of various types in a limited region of the rpoB gene (see, e.g., Yang (1998) J. Antimicrob. Chemother. 42:621–628).

Using the methods of the invention, as expected, functional linkages were found to another RNA polymerase subunit, rpoC, as well as to various tRNA synthases and ribosomal proteins. However, no functional links to uncharacterized proteins were found.

Ethambutol. This drug is effective against tuberculosis when used in combination with isoniazid. It is believed that the drug interacts with the EmbB protein, a probable arabinosyl-transferase, inhibiting the biosynthesis of arabinan, a component of cell-envelope lipids. As with rifampicin, the evidence for this interaction is indirect, since mutations in the embB gene are responsible for ethambutol resistance (see, e.g., Lety (1997) Antimicrob. Agents Chemother. 41:2629–2633).

The "gene proximity" method correctly clusters embB with embA (Rv3794). This cluster is linked to a set of mostly uncharacterized genes by the "phylogenetic profile" method; see FIG. 2, which shows an analysis of EmbB, the target for the anti-tuberculosis drug Ethambutol, and shows functional linkages to genes mostly of unknown function but with some indications of localization at the bacterial membrane.

Two of the uncharacterized genes, Rv1706c and Rv1800, belong to the abundant PE/PPE family of proteins hypothesized to be a source of antigenic variation with the potential ability to interfere with immune responses by inhibiting antigen processing (see, e.g., Cole (1998) Nature 393, 537–544). A third uncharacterized gene, Rv1967 belongs to the one of the four copies of the mce operon. This operon consists of eight genes coding for integral membrane proteins and proteins that have N-terminal signal sequences or hydrophobic segments and are believed to be involved in pathogenicity (see, e.g., Cole (1998) supra). Rv0528 codes for a hypothetical membrane protein and Rv2159c corresponds to the murF gene, which participates in the biosynthesis of peptidoglycan precursors.

The majority of the "links," or functionally associated sequences, involved proteins associated with processes related to the bacterial cell wall (with the possible exception of atsA and the putative choline dehydrogenase Rv1279, whose relationship to these processes is not immediately obvious). The proteins of unknown function are therefore also expected to play some role in these processes and are thus of interest as potential drug targets.

Streptomycin. This drug acts by binding to the 16S rRNA and inhibits protein synthesis. Resistance to this compound emerges from mutations in the corresponding gene (rrs), as well as in the gene encoding for the ribosomal protein S12 (rpsL). Disruptions to RpsL effect streptomycin resistance by altering the higher order structure of 16S rRNA (see, e.g., Sreevatsan (1996) Antimicrob. Agents Chemother. 40:1024–1026).

Although streptomycin doesn't directly target RpsL, the functional links generated for this protein was examined, as any target whose inhibition will ultimately disrupt bacterial protein synthesis is likely to be an effective antigrowth/antimicrobial target. As with the rifampicin target, the only functional linkages found for this protein were the expected protein synthesis-related proteins, including large ribosomal subunit proteins L2, L5, L11, and L14; small ribosomal subunit proteins S4, S5, S7, S8, and S11; elongation factors fusA and Ef-Tu; the chaperones GroEL, clpB and ftsH; and the Clp protease subunits clpC and clpX.

Proteins Linked to Cell-wall Related Proteins

The invention also provides a novel method for identifying a nucleic acid or a polypeptide sequence in an organism that is linked to a cell-wall related protein. The method analyzes the functional relationship between at least two sequences, wherein at least one of the sequences is a cell-wall related protein, or, the sequence is a nucleic acid sequence that encodes a cell-wall related protein. The method comprises identifying proteins, and the genes that encode them, that are functionally linked to a cell-wall related protein. The functional linkage is determined by using the "domain fusion" method, the "phylogenetic profile" method or the "physiologic linkage" method, or a combination thereof, as described herein.

Figure 3:
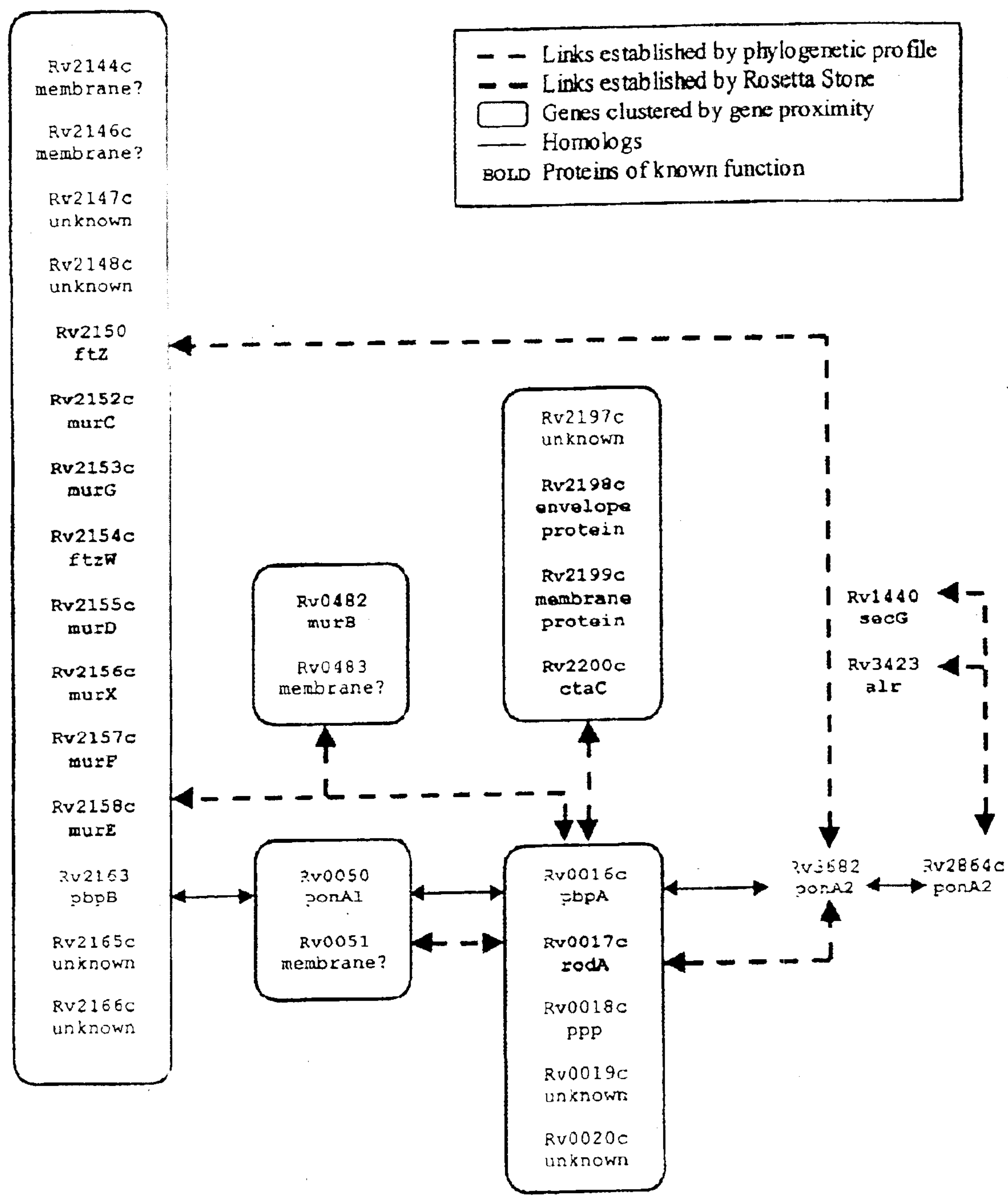
FIG. 3 is an example of predicted functional linkages between five TB genes having homology to penicillin binding proteins and other TB genes.

Approximately eleven *M. tuberculosis* proteins are indicated by sequence homology to be penicillin-binding proteins, thought to synthesize peptidoglycan in the course of cell elongation and cell wall metabolism (see, e.g., Broome-Smith (1985) Eur. J. Biochem. 147:437–446). Using the methods of the invention, the functional linkages found for these proteins map out many of the known cell wall synthetic enzymes and reveal more than 10 proteins of unknown function that may also participate in cell wall metabolism. FIG. 3 shows an analysis of five of the approximately eleven MTB proteins presumed to bind penicillin to reveal functional linkages to various potential operons consisting of genes involved in various aspects of cell wall metabolism, including cell shape determination and peptidoglycan biosynthesis, as well more than ten genes of unknown function, which we can now associate with cell wall metabolism.

Three of the proteins (pbpA, pbpB, and ponA1) reside in conserved gene clusters, presumably operons. Other genes in the clusters around pbpA and pbpb are also implicated in cell wall metabolism. For example, pbpA resides next to rodA, a membrane-associated protein whose *E. coli* homolog determines cell shape and is required for enzymatic activity of penicillin binding proteins (see, e.g., Matsuzawa (1989) J. Bacteriol. 171:558–560). Likewise, pbpB resides next to six peptidoglyean biosynthesis genes and the two septum and cell wall formation proteins ftsW and ftsZ.

Two additional gene clusters were linked to these penicillin binding proteins by either the "phylogenetic profile" or "Rosetta Stone" pattern methods of the invention. One cluster is composed of the peptidoglycan synthetic protein murB and a putative membrane protein of unknown function that the functional linkages suggest is involved in cell wall metabolism. The second gene cluster contains four genes, three of which are predicted to reside in the cell membrane or envelope. Therefore, the uncharacterized genes in these clusters are likely to be involved in cell wall metabolism, closely related to the function of the penicillin binding proteins and are therefore promising drug targets.

Figure 4:
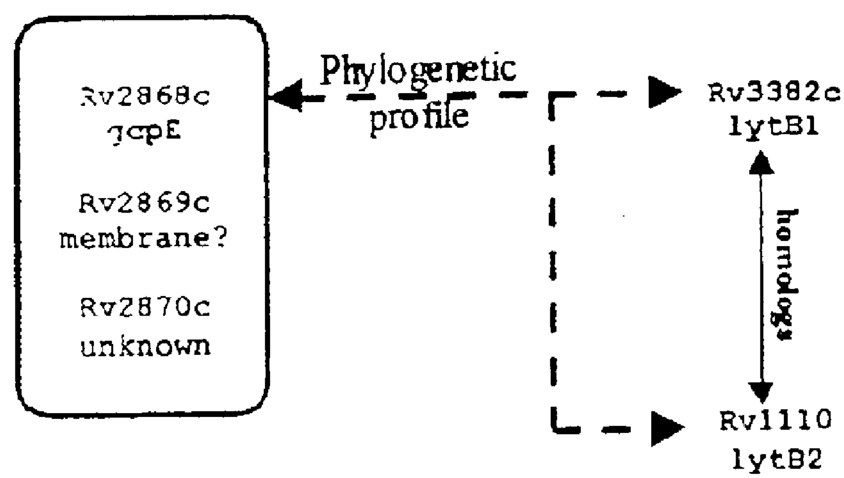
FIG. 4 shows that gcpE.(Rv 2868C) is predicted to be functionally linked to cell wall metabolism.
Figure 5:
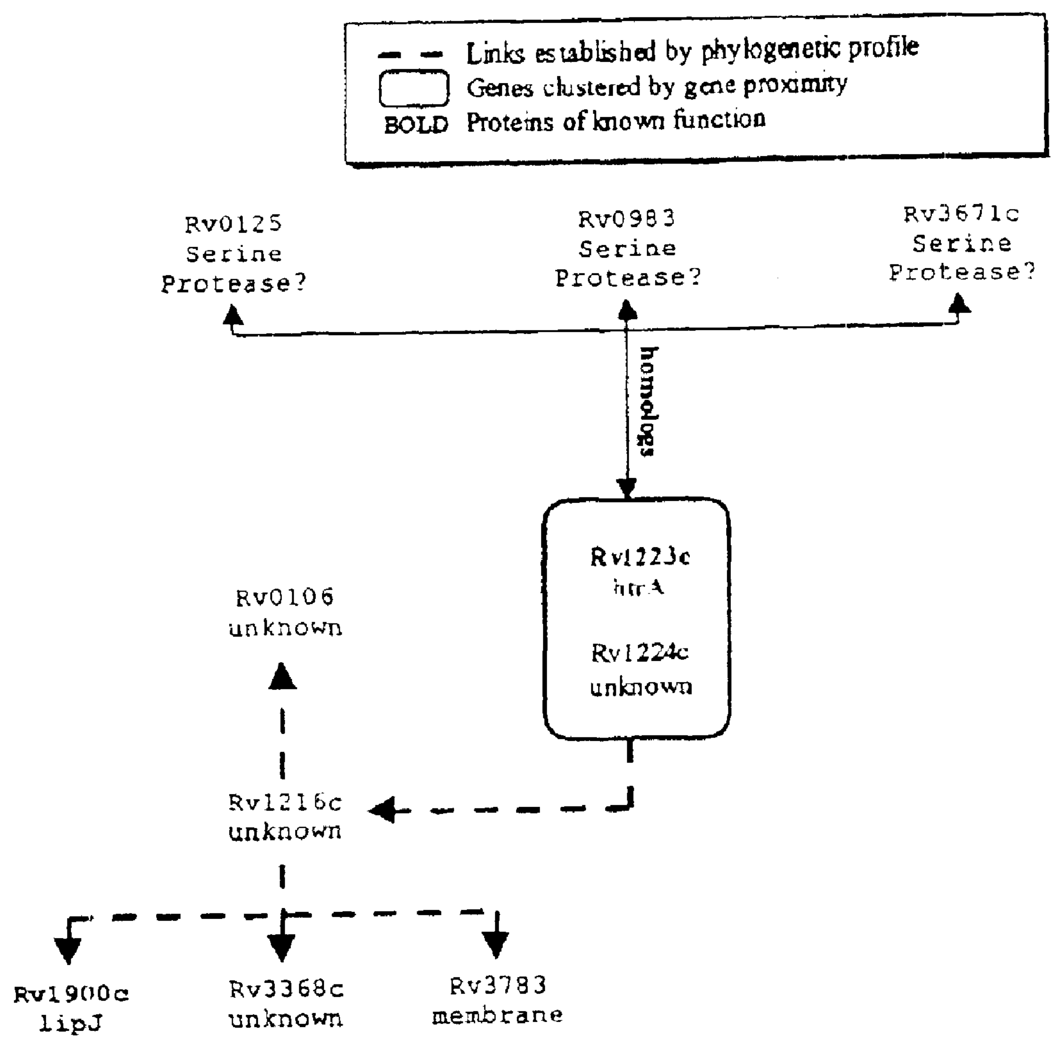
FIG. 5 shows predicted functional linkages of htrA (Rv 1223C) with other TB genes.

Another gene linked to cell wall metabolism by the computationally-derived linkage methods of the invention is gcpE, see FIG. 4, which shows that the uncharacterized gene gcpE, known to be essential for bacterial survival (see, e.g., Baker (1992) FEMS Microbiol. Lett. 73:175–180), is predicted to be involved in cell wall metabolism through its functional links to a putative membrane protein and two murein hydrolase genes, lytB1 and lytB2, involved in cell separation. The genes forming a putative operon with gcpE are proposed as potential drug targets. The functional linkages place gcpE in a conserved gene cluster with two genes of unknown function, one of which encodes a membrane protein. However, the three genes show correlated inheritance with two homologs of lytB, an *E. coli* gene involved in penicillin tolerance (see, e.g, Gustafson (1993) J. Bacteriol. 175:1203–1205) and recently shown to encode a murein hydrolase essential for cell separation (see, e.g., Garcia (1999) Mol. Microbiol. 31:1275–1277). The uncharacterized proteins from this cluster are therefore expected to participate in processes similar to GcpE and might therefore be promising drug targets.

Proteins Linked to Potentially Novel Pathways

The invention also provides a novel method for identifying a polypeptide, or a nucleic acid that encodes it, that is linked to potentially novel biochemical (e.g., biosynthetic, metabolic) pathways. The method analyzes the functional relationship between at least two sequences, wherein at least one of the sequences is associated with a biochemical pathway, such as a pathway in a microorganism that enables the pathogen to evade an immune process. The method comprises identifying proteins, and the genes that encode them, that are functionally linked to the pathway-linked sequences. The functional linkage is determined by using the "domain fusion" method, the "phylogenetic profile" method or the "physiologic linkage" method, or a combination thereof, as described herein.

For example, the htrA gene encodes for a putative heat shock protein homologous to HtrA from *Salmonella typhimurium*, a serine protease that degrades aberrant periplasmic proteins. Mutations in this protein have been linked with reduced viability in host macrophages (see, e.g., Johnson (1991) Mol. Microbiol. 5:401–407). Thus, it was decided to investigate the function of htrA. Using the methods of the invention, results indicated that the htrA protein is part of a process that has not yet been characterized. The gene is predicted with very high reliability to function with the uncharacterized gene Rv1224c, see FIG. 5, which shows the involvement of htrA in a potentially novel pathway and the gene encoding the putative heat shock protein HtrA is functionally linked to a set of genes mostly of unknown function, suggesting the existence of a novel pathway. The partially characterized proteins suggest that the pathway relates to membrane-associated processes such as signaling and/or transport. The lack of eukaryotic homologs for most of the genes linked to htrA, suggests that proteins of this pathway could be promising drug targets.

Through its phylogenetic profile, htrA is linked to a group of uncharacterized proteins, including a putative lipid esterase (Rv1900c), an ABC transporter (Rv3783) and the uncharacterized protein Rv1216c, which has weak homology to the laminin B receptor of *Xenopus laevis*, suggesting that it might be a membrane protein. From this analysis, it can be concluded that htrA is part of a novel pathway that involves membrane-associated processes, such as signaling and/or transport. Because the majority of the proteins linked to htrA have no eukaryotic homologs, and given the importance of htrA in *S. typhimurium* pathogenesis, this pathway represents another potential source of novel targets for anti-tuberculosis drugs.

Proteins Linked to Essential Proteins

The invention also provides a novel method for identifying a polypeptide, or the nucleic acid sequence that encodes it, that is linked to an essential protein (e.g., a protein necessary for the growth of an organism, such as a bacterium). The method analyzes the functional relationship between at least two sequences, wherein at least one of the sequences is linked to an essential protein, or, the sequence is a nucleic acid sequence that itself is essential or encodes a polypeptide linked to an essential protein. The functional linkage is determined by using the "domain fusion" method, the "phylogenetic profile" method or the "physiologic linkage" method, or a combination thereof, as described herein.

For example, the MIPS database (Munich Information Center for Protein Sequences; MIPS provides access through its WWW server to a spectrum of generic databases, including PEDANT, MYGD, MATD, MEST, the PIR-Intemational Protein Sequence Database, the protein family database PROTFAM, the MITOP database, and the all-against-all FASTA database; see, e.g., Mewes (1999) Nucleic Acids Res. 27:44–48) contains a list of 734 genes that are essential for *Saccharomyces cerevisiae* viability (see, e.g., Mewes (1999) supra). A list of *Mycobacterium tuberculosis* genes orthologous to these essential genes was generated. Using the methods of the invention, 60 such genes were found. The products of these genes have a high likelihood of also being essential to the tuberculosis bacterium and therefore could be promising therapeutic targets. Furthermore, since the list of essential genes came from a eukaryote, there is a significant chance that these genes would also be found in the human genome.

Automatic Method to Identify Drug Targets from Functional Linkages

One aspect of the invention provides a computational method to identify potential drug targets among the proteins expressed by a genome. This aspect takes advantage of the functional linkages calculated between genes in a genome using the methods described herein, as well as the detection of sequence homology and the knowledge of a set of lethal or "essential" genes in one or more organisms.

To identify drug targets in a query genome, the sequence homology between all of the genes in that genome and all of the genes in the genome of an organism for which essential genes are known is calculated. For example, as discussed herein, the query genome is *Mycobacterium tuberculosis* (TB) and the genome with known essentials is the yeast *S. cerevisiae*. Sequence homology between all TB genes and all yeast genes was calculated using the methods of the invention.

"Equivalent" or "orthologous" genes were also identified by another aspect of the invention that comprises doing a reverse sequence search (e.g., yeast vs. TB) and then choosing pairs of genes that are the symmetric best-scoring sequence search. In one exemplary aspect, MTB orthologs of *Saccharomyces cerevisiae* genes were generated by finding all pairs of genes ($TB_i$,$SC_j$) where $TB_i$ was the top hit from a BLAST search of the yeast gene $SC_j$ against the MTB genome, $SC_j$ was the top hit from a BLAST search of the MTB gene $TB_i$ against the *Saccharomyces cerevisiae* genome and both top hits had a BLAST E-value<=$1\times10^{-5}$.

For example, a TB gene is an ortholog of a yeast gene if the yeast gene is the best scoring sequence match when yeast is searched with the TB gene, and the TB gene is the best scoring sequence match when TB is searched with the yeast gene. We define these symmetric" pairs as "orthologs."

After identifying orthologs between the query genome and the genome with known essential genes, a set of query genome genes that are orthologs of known essential genes in the other genome was chosen. These genes were designated the set of "putative essentials". For the purposes of the algorithm of the invention, these query genome genes are assumed to be essential genes, since they are the equivalents of essential genes in another genome. These genes act as "markers" or indicators of essential pathways in the query genome. One could supplement this set with genes already known to be essential in the query organism. Functional linkages (determined by the methods of the invention) between all query genome genes were examined. The query genome genes linked to all of the putative essential genes were examined. This set of genes was designated as the "predicted members of essential pathways." These genes are likely to be involved in important pathways, since the (predicted) pathways have members that are putative essentials. Lastly, the method removes from the set of genes in predicted essential pathways all of those genes that have sequence homology to eukaryotic genes or proteins. The genes that remain after this filtering step are the predicted drug targets for the query organism.

As a benchmark, this method was applied to the *M. tuberculosis* genome. Of the over 3900 genes in TB, 11 were identified as potential drug targets. Comparing this list of 11 predicted targets to the less than 10 known drug anti-TB drug targets, one gene was a known drug target and one was linked to a known drug target. Accordingly, the algorithm of the invention performed statistically significantly much better than a random choice of genes. A rough estimate of statistical significance suggests that one would expect to see 2 of 10 known drug targets in a sample of 11 out of 3900 genes only 3.8 times out of 10,000 trials (probability of occurring by random chance of $3.8\times10^{-4}$). Therefore, this embodiment of the method is an entirely computational algorithm drawing on the demonstrated ability of the general methods of the invention to predict functional linkages between genes and to effectively identify drug targets in bacteria. The effectiveness of this method to identify novel drug targets was clearly demonstrated when the algorithm was applied to the *M. tuberculosis* genome.

The specific inhibition of the MTB homologs might be difficult. To address this issue, using the methods of the invention, functional links to the essential genes were searched. Functional links were selected which either do not have homologs in yeast, or the enzymatic activity of their products are known to be absent in human cells. Using the highest confidence data, functional links for 23 of the genes (indicated in bold in Table 1) were found.

TABLE 1

| Name† | Gene | Comments |
|---|---|---|
| **Rv0005**‡ | gyrB | DNA gyrase subunit B |
| **Rv0014c** | pknB | serine-threonine protein kinase |
| Rv0032 | bicF2 | C-terminal similar to *B. subtilis* BroF |
| Rv0350 | dnaK | 70 kD heat shock protein. chromosome replication |
| Rv0363c | fba | fructose bisphosphate aldolase |
| **Rv0435c** | — | ATPase of AAA-family |
| **Rv0436c** | pssA | CDP-diacylglycerol-serine o-phosphatidyltransferase |
| Rv0440 | groEL2 | 60 kD chaperonin 2 |
| Rv0489 | gpm | phosphoglycerate mutase 1 |
| **Rv0490** | senX3 | sensor histidine kinase |
| Rv0500 | proC | pyrroline-5-carboxylate reductase |
| **Rv0667** | rpoE | [beta] subunit of RNA polymerase |
| **Rv0668** | rpoC | [beta]' subunit of RNA polymerase |
| Rv0764c | — | possible lanosterol 14-demethylase cytochrome P450 |
| Rv0861c | — | probable DNA helicase |
| Rv1010 | ksgA | 16S rRNA dimethyltransferase |
| Rv1106c | — | probable cholesterol dehydrogenase |
| Rv1229c | mrp | similar to MRP/NBP35 ATP-binding proteins |
| Rv1239c | corA | probable magnesium and cobalt transport protein |
| **Rv1294** | thrA | homoserine dehydrogenase |
| Rv1323 | fadA4 | acetyl-CoA C-acetyltransferase (aka thiL) |

TABLE 1-continued

| Name† | Gene | Comments |
|---|---|---|
| **Rv1389** | gmk | putative guanylate kinase |
| **Rv1407** | fmu | similar to Fmu protein |
| Rv1409 | ribG | riboflavin biosynthesis |
| Rv1617 | pykA | pyruvate kinase |
| Rv1630 | rpsA | 30S ribosomal protein S1 |
| Rv1745c | — | similar to Q46822 ORF_O182 |
| Rv1844c | gnd | 6-phosphogluconate dehydrogenase (Gram −) |
| Rv1981c | nrdF | ribonucleotide reductase small subunit |
| Rv2092c | helY | probable helicase. Ski2 subfamily |
| Rv2101 | helZ | probable helicase. Snf2/Rad54 family |
| Rv2110c | prcB | proteasome [beta]-type subunit 2 |
| Rv2118c | — | =B2126_C1_165 (83.6%) |
| **Rv2438c** | — | similar to YHN4_YEAST P38795 |
| **Rv2439c** | proB | glutamate 5-kinase |
| **Rv2448c** | valS | valyl-tRNA synthase |
| Rv2509 | — | putative oxidoreductase |
| Rv2524c | fas | fatty acid synthase |
| Rv2555c | alaS | alanyl-tRNA synthase |
| Rv2580c | hisS | histidyl-tRNA synthase |
| Rv2614c | thrS | threonyl-tRNA synthase |
| Rv2697c | dut | deoxyuridine triphosphatase |
| **Rv2782c** | pepR | protease/peptidase. M16 family (insulinase) |
| **Rv2793c** | truB | tRNA pseudouridine 55 synthase |
| **Rv2922c** | smc | member of Smc1/Cut3/Cut14 family |
| Rv2925c | rnc | RNAse III |
| Rv3014c | ligA | DNA ligase |
| **Rv3025c** | — | NifS-like protein |
| **Rv3080c** | pknK | serine-threonine protein kinase |
| Rv3106 | fprA | adrenodoxin and NADPH ferredoxin reductase |
| Rv3255c | manA | mannose-6-phosphate isomerase |
| Rv3264c | rmlA2 | glucose-1-phosphate thymidyltransferase |
| **Rv3418c** | groES | 10 kD chaperone |
| **Rv3490** | otsA | probable [alpha].-trehalose-phosphate synthase |
| **Rv3598c** | lysS | lysyl-tRNA synthase |
| **Rv3608c** | folP | dihydropteroate synthase |
| **Rv3609c** | folE | GTP cyclohydrolase I |
| Rv3721c | dnaZX | DNA polymerase III, [gamma] (dnaZ) and t (dnaX) |
| Rv3834c | serS | seryl-tRNA synthase |
| Rv3907c | pcnA | polynucleotide polymerase |

†We follow the Sanger Centre naming convention for MTB genes.
‡Genes for which high-confidence functional links were found shown in boldface Eight of these were linked to 12 unique MTB genes that satisfied the criteria of the invention's methods (Table 1). Exemplary findings include:

(1) the gene folP, which encodes the enzyme dihydropteroate synthase (DHPS) known to be the target of sulfonamide antibacterial drugs. Although it is found in some eukaryotes, DHPS activity is not found in human cells (see, e.g., Huovinen (1995) Antimicrob. Agents Chemother. 39:279–2890.

(2) the product of the gene folK, a 7,8-dihydro-6-hydroxymethyl-pterinpyrophosphokinase, has recently been proposed as a target for broad-spectrum antibacterial drugs (see, e.g., Stammers (1999) FEBS Lett. 456:49–53).

(3) the gene gpsI, is not only strongly linked to the essential yeast gene pepR, but it is also functionally linked to inhA, the target of the drug isoniazid (see above), making it a very compelling candidate for drug design.

TABLE 2

Subset of genes from Table 1 that are functionally linked to genes without yeast homologs.

| Gene | Link† | | Comments |
|---|---|---|---|
| Rv0005 | **Rv0002** | dnaN | DNA polymerase III, β-subunit |
| | **Rv0003** | recF | DNA replication and SOS induction |
| | Rv0006 | gyrA | DNA gyrase subunit A |
| Rv0350 | **Rv0351** | grpE | stimulates DnaK ATPase activity |
| | Rv0352 | dnaJ | acts with GrpE to stimulate DnaK ATPase |
| Rv1010 | **Rv1008** | | Similar to *E. coli* hypothetical protein YcfH |
| | **Rv1009** | | Possible lipoprotein, similar to various other MTB proteins |
| | **Rv1011** | | Similar to *E. coli* hypothetical protein YcbH |
| Rv2439c | Rv2427c | proA | γ-glutamyl phosphate reductase |
| | Rv2440c | obg | Obg GTP-binding protein |
| | Rv2441c | rpmA | 50S ribosomal protein L27 |
| | **Rv2442c** | rplU | 50S ribosomal protein L21 |
| Rv2782c | **Rv2783c** | gpsI | pppGpp synthase and polyribonucleotide phosphorylase |
| Rv3598c | **Rv3600c** | | similar to *Bacillus subtilis* hypothetical protein YacB |
| | **Rv3606c** | folK | 7,8-dihydro-6-hydroxymethylpterin pyrophosphokinase |
| | **Rv3607c** | folX | may be involved in folate biosynthesis |
| | **Rv3608c**‡ | folP | dihydropteroate synthase (DHPS) |
| | Rv3610c | ftsH | inner membrane protein, chaperone |
| Rv3608c | Rv3598c | lysS | lysyl-tRNA synthase |
| | **Rv3600c** | | similar to *Bacillus subtilis* hypothetical protein YacB |
| | **Rv3606c** | folK | 7,8-dihydro-6-hydroxymethylpterin pyrophosphokinase |
| | **Rv3607c** | folX | may be involved in folate biosynthesis |
| | Rv3609c | folE | GTP cyclohydrolase I |
| | Rv3610c | ftsH | inner membrane protein, chaperone |
| Rv3609c | **Rv3606c** | folK | 7,8-dihydro-6-hydroxymethylpterin pyrophosphokinase |
| | **Rv3607c** | folx | may be involved in folate biosynthesis |
| | **Rv3608c**‡ | folP | dihydropteroate synthase (DHPS) |

†Genes without yeast homologs shown in boldface
‡DHPS activity is found in some eukaryotic cells but not in human cells In summary, the methods of the invention allowed identification of this combination of functional linkages to essential genes. This information, together with the lack of eukaryotic homologs for these genes, makes this group of proteins promising drug targets, particularly because their inhibition is expected to disrupt vital bacterial processes with a low likelihood of toxicity from the inhibition of a host equivalent.

Computer Implementation

The various techniques, methods, and aspects of the invention described herein can be implemented in part or in whole using computer-based systems and methods. Additionally, computer-based systems and methods can be used to augment or enhance the functionalities and algorithms described herein, increase the speed at which the functions can be performed, and provide additional features and aspects as a part of or in addition to those of the invention described elsewhere in this document. Various exemplary computer-based systems, methods and implementations in accordance with the above-described technology are presented herein.

The processor-based system can include a main memory, such as a random access memory (RAM), and can also include a secondary memory. The secondary memory can include, for example, a hard disk drive and/or a removable storage drive, representing a floppy disk drive, a magnetic tape drive, an optical disk drive, etc. The removable storage drive reads from and/or writes to a removable storage medium. Removable storage media can be a floppy disk magnetic tape, an optical disk, and the like, which can be read by and written to by removable storage drive. The removable storage media can includes a computer usable storage medium having stored therein computer software and/or data.

In alternative embodiments, secondary memory may include other similar means for allowing computer programs or other instructions to be loaded into a computer system. Such means can include, for example, a removable storage unit and an interface. Examples of such can include a program cartridge and cartridge interface (such as the found in video game devices), a movable memory chip (such as an EPROM, or PROM) and associated socket, and other removable storage units and interfaces that allow software and data to be transferred from the removable storage unit to the computer system.

The computer system can also include a communications interface. Communications interfaces allow software and data to be transferred between computer system and external devices. Examples of communications interfaces include modems, network interfaces (such as, for example, an Ethernet card), communications ports, PCMCIA slots and cards, and the like. Software and data transferred via a communications interface can be in the form of signals that can be electronic, electromagnetic, optical or other signals capable of being received by a communications interface. These signals can be provided to communications interface via a channel capable of carrying signals and can be implemented using a wireless medium, wire or cable, fiber optics or other communications medium. Some examples of a channel can include a phone line, a cellular phone link, an RF link, a network interface, and other communications channels.

As used herein, the terms "computer program medium" and "computer usable medium" are used to generally refer to media such as a removable storage device, a disk capable of installation in a disk drive, and signals on a channel, or equivalents thereof. These computer program products are means for providing software or program instructions to computer systems. Computer programs (also called computer control logic) can be stored in main memory and/or secondary memory. Computer programs can also be received via a communications interface. Such computer programs, when executed, enable the computer system to perform the features of the present invention as discussed herein. Computer programs when executed, enable the processor to perform the features of the present invention. Accordingly, in one aspect of the invention, such computer programs represent controllers of the computer system.

In another aspect of the invention the methods and algorithms arc implemented using software, the software may be stored in, or transmitted via, a computer program product and loaded into a computer system using a removable storage drive, hard drive or communications interface. The control logic (software), when executed by the processor, causes the processor to perform the functions of the invention as described herein.

In another aspect, the elements are implemented primarily in hardware using, for example, hardware components such as PALs, application specific integrated circuits (ASICs) or other hardware components. Implementation of a hardware state machine so as to perform the functions described herein will be apparent to person skilled in the relevant art(s). In yet another embodiment, elements are implanted using a combination of both hardware and software.

In another aspect, the computer-based methods can be accessed or implemented over the World Wide Web by providing access via a Web Page to the methods of the present invention. Accordingly, the Web Page is identified by a Universal Resource Locator (URL). The URL denotes both the server machine, and the particular file or page on that machine. In this embodiment, it is envisioned that a consumer or client computer system interacts with a browser to select a particular URL, which in turn causes the browser to send a request for that URL or page to the server identified in the URL. Typically the server responds to the request by retrieving the requested page, and transmitting the data for that page back to the requesting client computer system (the client/server interaction is typically performed in accordance with the hypertext transport protocol ("HTTP")). The selected page is then displayed to the user on the client's display screen. The client may then cause the server containing a computer program of the present invention to launch an application comprising a method of the invention, for example, to identify a nucleic acid or a polypeptide sequence that may be a target for a drug comprising the steps of (a) providing a first nucleic acid or a polypeptide sequence that is known to be a drug target; (b) providing an algorithm capable analyzing a functional relationship between nucleic acid or polypeptide sequences selected from the group consisting of a "domain fusion" method, a "phylogenetic profile" method and a "physiologic linkage" method; and, (c) comparing the first nucleic acid or the polypeptide drug target sequence to a plurality of sequences using at least one algorithm to identify a second sequence that has a functional relationship to the first sequence, thereby identifying a nucleic acid or a polypeptide sequence that may be a target for a drug, based on a query sequence provided by the client.

Nucleic Acids and Polypeptides

The invention also provides isolated nucleic acids and polypeptides comprising the sequences as set forth in Table 3 and Table 4 (below). As used herein, "isolated," when referring to a molecule or composition, such as, e.g., an isolated infected cell comprising a nucleic acid sequence derived from a library of the invention, means that the molecule or composition (including, e.g., a cell) is separated from at least one other compound, such as a protein, DNA, RNA, or other contaminants with which it is associated in vivo or in its naturally occurring state. Thus, a nucleic acid or polypeptide or peptide sequence is considered isolated when it has been isolated from any other component with which it is naturally associated. An isolated composition can, however, also be substantially pure. An isolated composition can be in a homogeneous state. It can be in a dry or an aqueous solution. Purity and homogeneity can be determined, e.g., using any analytical chemistry technique, as described herein.

The term "nucleic acid" or "nucleic acid sequence" refers to a deoxy-ribonucleotide or ribonucleotide oligonucleotide, including single- or double-stranded, or coding or non-coding (e.g., "antisense") forms. The term encompasses nucleic acids, i.e., oligonucleotides, containing known analogues of natural nucleotides. The term also encompasses nucleic-acid-like structures with synthetic backbones, see e.g., Oligonucleotides and Analogues, a Practical Approach, ed. F. Eckstein, Oxford Univ. Press (1991); Antisense Strategies, Annals of the N.Y. Academy of Sciences, Vol 600, Eds. Baserga et al. (NYAS 1992); Milligan (1993) J. Med. Chem. 36:1923–1937; Antisense Research and Applications (1993, CRC Press), WO 97/03211; WO 96/39154; Mata (1997) Toxicol. Appl. Pharmacol. 144:189–197; Strauss-Soukup (1997) Biochemistry 36:8692–8698; Samstag (1996) Antisense Nucleic Acid Drug Dev 6:153–156. As used herein, the "sequence" of a nucleic acid or gene refers to the order of nucleotides in the polynucleotide, including either or both strands (sense and antisense) of a double-stranded DNA molecule, e.g., the sequence of both the coding strand and its complement, or of a single-stranded nucleic acid molecule (sense or anti sense). For example, in alternative embodiments, promoters drive the transcription of sense and/or antisense polynucleotide sequences of the invention, as exemplified by Table 3.

The terms "polypeptide," "protein," and "peptide" include compositions of the invention that also include "analogs," or "conservative variants" and "mimetics" ("peptidomimetics") with structures and activity that substantially correspond to the exemplary sequences, such as the sequences in Table 4. Thus, the terms "conservative variant" or "analog" or "mimetic" also refer to a polypeptide or peptide which has a modified amino acid sequence, such that the change(s) do not substantially alter the polypeptide's (the conservative variant's) structure and/or activity (e.g., immunogenicity, ability to bind to human antibodies, etc.), as defined herein. These include conservatively modified variations of an amino acid sequence, i.e., amino acid substitutions, additions or deletions of those residues that are not critical for protein activity, or substitution of amino acids with residues having similar properties (e.g., acidic, basic, positively or negatively charged, polar or non-polar, etc.) such that the substitutions of even critical amino acids does not substantially alter structure and/or activity. Conservative substitution tables providing functionally similar amino acids are well known in the art. For example, one exemplary guideline to select conservative substitutions includes (original residue followed by exemplary substitution): ala/gly or ser; arg/lys; asn/gln or his; asp/glu; cys/ser; gln/asn; gly/asp; gly/ala or pro; his/asn or gln; ile/leu or val; leu/ile or val; lys/arg or gln or glu; met/leu or tyr or ile; phe/met or leu or tyr; ser/thr; thr/ser; trp/tyr; tyr/trp or phe; val/ile or leu. An alternative exemplary guideline uses the following six groups, each containing amino acids that are conservative substitutions for one another: 1) Alanine (A), Serine (S), Threonine (T); 2) Aspartic acid (D), Glutamic acid (E); 3) Asparagine (N), Glutarnine (Q); 4) Arginine (R), Lysine (K); 5) Isoleucine (1), Leucine (L), Methionine (M), Valine (V); and 6) Phenylalanine (F), Tyrosine (Y), Tryptophan (W); (see also, e.g., Creighton (1984) Proteins, W. H. Freeman and Company; Schulz and Schimer (1979) Principles of Protein Structure, Springer-Verlag). One of skill in the art will appreciate that the above-identified substitutions are not the only possible conservative substitutions. For example, for some purposes, one may regard all charged amino acids as conservative substitutions for each other whether they are positive or negative. In addition, individual substitutions, deletions or additions that alter, add or delete a single amino acid or a small percentage of amino acids in an encoded sequence can also be considered "conservatively modified variations."

The terms "mimetic" and "peptidomimetic" refer to a synthetic chemical compound that has substantially the same structural and/or functional characteristics of the polypeptides of the invention (e.g., ability to bind, or "capture," human antibodies in an ELISA). The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetics' structure and/or activity. As with polypeptides of the invention which are conservative variants, routine experimentation will determine whether a mimetic is within the scope of the invention, i.e., that its structure and/or function is not substantially altered. Polypeptide mimetic compositions can contain any combination of non-natural structural components, which are typically from three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. A polypeptide can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(═O)—$CH_2$— for —C(═O)—NH—), aminomethylene ($CH_2$—NH), ethylene, olefin (CH═CH), ether ($CH_2$—O), thioether ($CH_2$—S), tetrazole ($CN_4$—), thiazole, retroamide, thioamide, or ester (see, e.g., Spatola (1983) in Chemistry and Biochemistry of Amino Acids, Peptides and Proteins, Vol. 7, pp 267–357, "Peptide Backbone Modifications," Marcell Dekker, N.Y.). A polypeptide can also be characterized as a mimetic by containing-all or some non-natural residues in place of naturally occurring amino acid residues; non-natural residues are well described in the scientific and patent literature.

The invention comprises nucleic acids comprising sequences as set forth in Table 3, or comprising nucleic acids encoding the polypeptides as set forth in Table 4, operably linked to a transcriptional regulatory sequence. As used herein, the term "operably linked," refers to a functional relationship between two or more nucleic acid (e.g, DNA) segments. Typically, it refers to the functional relationship of a transcriptional regulatory sequence to a transcribed sequence. For example, a promoter (defined below) is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance. For example, in one embodiment, a promoter is operably linked to an ORF-containing nucleic acid sequence of the invention, as exemplified by, e.g., a nucleic acid sequence as set forth in Table 3.

As used herein, the term "promoter" includes all sequences capable of driving transcription of a coding sequence in an expression system. Thus, promoters used in the constructs of the invention include cis-acting transcriptional control elements and regulatory sequences that are involved in regulating or modulating the timing and/or rate of transcription of a nucleic acid of the invention. For example, a promoter can be a cis-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription.

The invention comprises expression cassettes comprising nucleic acids comprising sequences as set forth in Table 3, or comprising nucleic acids encoding the polypeptides as set forth in Table 4. The term "expression vector" refers to any recombinant expression system for the purpose of expressing a nucleic acid sequence of the invention in vitro or in vivo, constitutively or inducibly, in any cell, including prokaryotic, yeast, fungal, plant, insect or mammalian cell. The term includes linear or circular expression systems. The term includes expression systems that remain episomal or integrate into the host cell genome. The expression systems can have the ability to self-replicate or not, i.e., drive only transient expression in a cell. The term includes recombinant "expression cassettes" which contain only the minimum elements needed for transcription of the recombinant nucleic acid.

Alignment Analysis of sequences

The nucleic acid and polypeptide sequences of the invention include genes and gene products identified and characterized by sequence identify analysis (i.e., by homology) using the exemplary nucleic acid and protein sequences of the invention, including, e.g., those set forth in Tables 3 and 4. In alternative aspects of the invention, nucleic acids and polypeptides within the scope of the invention include those having 98%, 95%, 90%, 85% or 80% sequence identity (phomology) to the exemplary sequences as set forth in Table 3 and 4.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used unless alternative parameters are designated herein. The sequence comparison algorithm then calculates the percent sequence identity for the test sequence(s) relative to the reference sequence, based on the designated or default program parameters. A "comparison window", as used herein, includes reference to a segment of any one of the number of contiguous positions selected from the group consisting of from 25 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Natl. Acad. Sci. USA 85:2444 (1988), by computerized implementations of these algorithms (CLUSTAL, GAP, BESTFIT, FASTA, and TFASTA in the Wisconsin Genetics Software Package, Genetics Computer Group, 575 Science Dr., Madison, Wis.), or by manual alignment and visual inspection.

In one aspect of the invention (in the methods of the invention, and, to determine if a sequence is within the scope of the invention), a CLUSTAL algorithm is used, e.g., the CLUSTAL W program, see, e.g., Thompson (1994) Nuc. Acids Res. 22:4673–4680; Higgins (1996) Methods Enzymol 266:383–402. Variations can also be used, such as CLUSTAL X, see Jeanmougin (1998) Trends Biochem Sci 23:403–405; Thompson (1997) Nucleic Acids Res 25:4876–4882. In one aspect, the CLUSTAL W program described by Thompson (1994) supra, is used with the following parameters: K tuple (word) size: 1, window size: 5, scoring method: percentage, number of top diagonals: 5, gap penalty: 3, to determine whether a nucleic acid has sufficient sequence identity to an exemplary sequence to be with the scope of the invention. In another aspect, the algorithm PILEUP is used in the methods and to determine whether a nucleic acid has sufficient sequence identity to be with the scope of the invention. This program creates a multiple sequence alignment from a group of related sequences using progressive, pairwise alignments to show relationship and percent sequence identity. It also plots a tree or dendogram showing the clustering relationships used to create the alignment. PILEUP uses a simplification of the progressive alignment method of Feng & Doolittle, J. Mol. Evol. 35:351–360 (1987). The method used is similar to the method described by Higgins & Sharp, CABIOS 5:151–153 (1989). Using PILEUP, a reference sequence (e.g., an exemplary GCA-associated sequence of the invention) is compared to another sequence to determine the percent sequence identity relationship (i.e., that the second sequence is substantially identical and within the scope of the invention) using the following parameters: default gap weight (3.00), default gap length weight (0.10), and weighted end gaps. In one embodiment, PILEUP obtained from the GCG sequence analysis software package, e.g., version 7.0 (Devereaux (1984) *Nuc. Acids Res*. 12:387–395), using the parameters described therein, is used in the methods and to identify nucleic acids within the scope of the invention. In a another aspect, a BLAST algorithm is used (in the methods, e.g., to determine percent sequence identity (i.e., substantial similarity or identity) and whether a nucleic acid is within the scope of the invention), see, e.g., Altschul (1990) *J. Mol. Biol*. 215:403–410. Software for performing BLAST analyses is publicly available through the National Center for Biotechnology Information, NIH. This algorithm involves first identifying high scoring sequence pairs (HSPs) by identifing short words of length W in the query sequence, which either match or satisfy some positive-valued threshold score T when aligned with a word of the same length in a database sequence. T is referred to as the neighborhood word score threshold (Altschul (1990) supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues, always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. In one embodiment, to determine if a nucleic acid sequence is within the scope of the invention, the BLASTN program (for nucleotide sequences) is used incorporating as defaults a wordlength (W) of 11, an expectation (E) of 10, M=5, N=4, and a comparison of both strands. For amino acid sequences, the BLASTP program uses as default parameters a wordlength (W) of 3, an expectation (E) of 10, and the BLOSUM62 scoring matrix (see, e.g., Henikoff (1989) Proc. Natl. Acad. Sci. USA 89:10915).

Hybridizationfor Identifying Nucleic Acids of the Invention

Nucleic acids within the scope of the invention include isolated or recombinant nucleic acids that specifically hybridize under stringent hybridization conditions to an exemplary nucleic acid of the invention (including a sequence encoding an exemplary polypeptide) as set forth in Tables 3 and 4. Stringent conditions are sequence-dependent and will be different in different circumstances. Longer sequences hybridize specifically at higher temperatures. An extensive guide to the hybridization of nucleic acids is found in, e.g., Tijssen (1993) infra. Generally, stringent conditions are selected to be about 5 to 10° C. lower than the thermal melting point (Tm) for the specific sequence at a defined ionic strength and pH. The Tm is the temperature (under defined ionic strength, pH, and nucleic acid concentration) at which 50% of the probes complementary to the target hybridize to the target sequence at equilibrium (as the target sequences are present in excess, at Tm, 50% of the probes are occupied at equilibrium). Stringent conditions will be those in which the salt concentration is less than about 1.0 M sodium ion, typically about 0.01 to 1.0 M sodium ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide.

For selective or specific hybridization, a positive signal (e.g., identification of a nucleic acid of the invention) is about 10 times background hybridization. "Stringent" hybridization conditions that are used to identify substantially identical nucleic acids within the scope of the invention include hybridization in a buffer comprising 50% formamide, 5×SSC, and 1% SDS at 42° C., or hybridization in a buffer comprising 5×SSC and 1% SDS at 65° C., both with a wash of 0.2×SSC and 0.1% SDS at 65° C. Exemplary "moderately stringent hybridization conditions" include a hybridization in a buffer of 40% formamide, 1 M NaCl, and 1% SDS at 37° C., and a wash in 1×SSC at 45° C. Those of ordinary skill will readily recognize that alternative but comparable hybridization and wash conditions can be utilized to provide conditions of similar stringency. Nucleic acids which do not hybridize to each other under stringent hybridization conditions are still substantially identical if the polypeptides which they encode are substantially identical. This may occur, e.g., when a copy of a nucleic acid is created using the maximum codon degeneracy permitted by the genetic code, as discussed herein (see discussion on "conservative substitutions"). However, the selection of a hybridization format is not critical—it is the stringency of the wash conditions that set forth the conditions that determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1% SDS at 68° C. for 15 minutes; or, equivalent conditions. See Sambrook, Tijssen and Ausubel (see below) for a description of SSC buffer and equivalent conditions.

General Techniques

The nucleic acid and polypeptide sequences of the invention and other nucleic acids used to practice this invention, whether RNA, cDNA, genomic DNA, vectors, viruses or hybrids thereof, may be isolated from a variety of sources, genetically engineered, amplified, and/or expressed recombinantly. Any recombinant expression system can be used, including, in addition to bacterial cells, e.g., mammalian, yeast, insect or plant cell expression systems.

Alternatively, these nucleic acids and polypeptides can be synthesized in vitro by well-known chemical synthesis techniques, as described in, e.g., Carruthers (1982) Cold Spring Harbor Symp. Quant. Biol. 47:411–418; Adams (1983) J. Am. Chem. Soc. 105:661; Belousov (1997) Nucleic Acids Res. 25:3440–3444; Frenkel (1995) Free Radic. Biol. Med. 19:373–380; Blommers (1994) Biochemistry 33:7886–7896; Narang (1979) Meth. Enzymol. 68:90; Brown (1979) Meth. Enzymol. 68:109; Beaucage (1981) Tetra. Lett. 22:1859; U.S. Pat. No. 4,458,066.

Techniques for the manipulation of nucleic acids, such as, e.g., generating mutations in sequences, subcloning, labeling probes, sequencing, hybridization and the like are well described in the scientific and patent literature, see, e.g., Sambrook, ed., MOLECULAR CLONING; A LABORATORY MANUAL (2ND ED.), Vols. 1–3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRYDIZATION WITH NUCLEIC ACID PROBES, Part I. Theory and Nucleic Acid Preparation, Tijssen, ed. Elsevier, N.Y. (1993).

Polypeptides and peptides of the invention can also be synthesized, whole or in part, using chemical methods well known in the art. See e.g., Caruthers (1980) Nucleic Acids Res. Symp. Ser. 215–223; Horn (1980) Nucleic Acids Res. Symp. Ser. 225–232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3–13) and automated synthesis may be achieved, e.g., using the ABI 431 A Peptide Synthesizer (Perkin Elmer) in accordance with the instructions provided by the manufacturer.

The skilled artisan will recognize that individual synthetic residues and polypeptides incorporating mimetics can be synthesized using a variety of procedures and methodologies, which are well described in the scientific and patent literature, e.g., Organic Syntheses Collective Volumes, Gilman, et al. (Eds) John Wiley & Sons, Inc., NY. Polypeptides incorporating mimetics can also be made using solid phase synthetic procedures, as described, e.g., by Di Marchi, et al., U.S. Pat. No. 5,422,426. Peptides and peptide mimetics of the invention can also be synthesized using combinatorial methodologies. Various techniques for generation of peptide and peptidomimetic libraries are well known, and include, e.g., multipin, tea bag, and split-couple-mix techniques; see, e.g., al-Obeidi (1998) Mol. Biotechnol. 9:205–223; Hruby (1997) Curr. Opin. Chem. Biol. 1:114–119; Ostergaard (1997) Mol. Divers. 3:17–27; Ostresh (1996) Methods Enzymol. 267:220–234. Modified peptides of the invention can be further produced by chemical modification methods, see, e.g., Belousov (1997) Nucleic Acids Res. 25:3440–3444; Frenkel (1995) Free Radic. Biol. Med. 19:373–380; Blommers (1994) Biochemistry 33:7886–7896.

Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibodyexpressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between the purification domain and GCA-associated peptide or polypeptide can be useful to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787–1797; Dobeli (1998) Protein Expr. Purif. 12:404414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441–53.

The invention provides antibodies that specifically bind to the polypeptides of the invention, as set forth in Table 4. These antibodies can be useful in the screening methods of the invention. The polypeptides or peptide can be conjugated to another molecule or can be administered with an adjuvant. The coding sequence can be part of an expression cassette or vector capable of expressing the immunogen in vivo. (see, e.g., Katsumi (1994) Hum. Gene Ther. 5:1335–9). Methods of producing polyclonal and monoclonal antibodies are known to those of skill in the art and described in the scientific and patent literature, see, e.g., Coligan, CURRENT PROTOCOLS IN IMUNOLOGY, Wiley/Greene, N.Y. (1991); Stites (eds.) BASIC AND CLINICAL IMMUNOLOGY (7th ed.) Lange Medical Publications, Los Altos, Calif.; Goding, MONOCLONAL ANTIBODIES: PRINCIPLES AND PRACTICE (2d ed.) Academic Press, New York, N.Y. (1986); Harlow (1 988) ANTIBODES, A LABORATORY MANUAL, Cold Spring Harbor Publications, New York.

Antibodies also can be generated in vitro, e.g., using recombinant antibody binding site expressing phage display libraries, in addition to the traditional in vivo methods using animals. See, e.g., Huse (1989) Science 246:1275; Ward (1989) Nature 341:544; Hoogenboom (1997) Trends Biotechnol. 15:62–70; Katz (1997) Annu. Rev. Biophys. Biomol. Struct. 26:27–45. Human antibodies can be generated in mice engineered to produce only human antibodies, as described by, e.g., U.S. Pat. Nos. 5,877,397; 5,874,299; 5,789,650; and 5,939,598. B-cells from these mice can be immortalized using standard techniques (e.g., by fusing with an immortalizing cell line such as a myeloma or by manipulating such B-cells by other techniques to perpetuate a cell line) to produce a monoclonal human antibody-producing cell. See, e.g., U.S. Pat. Nos. 5,916,771; 5,985,615.

TABLE 3

```
>Rv0002 dnaN DNA polymerase III, b-subunit TB.seq 2052:3257 MW:42114
>emb|AL123456|MTBH37RV:2052–3260, dnaN SEQ ID NO:1
ATGGACGCGGCTACGACAAGAGTTGGCCTCACCGACTTGACGTTTCGTTTGCTACGAGAGTCTT
TCGCCGATGCGGTGTCGTGGGTGGCTAAAAATCTGCCAGCCAGGCCCGCGGTGCCGGTGCTCT
CCGGCGTGTTGTTGACCGGCTCGGACAACGGTCTGACGATTTCCGGATTCGACTACGAGGTTTC
CGCCGAGGCCCAGGTTGGCGCTGAAATTGTTTCTCCTGGAAGCGTTTTAGTTTCTGGCCGATTG
TTGTCCGATATTACCCGGGCGTTGCCTAACAAGCCCGTAGACGTTCATGTCGAAGGTAACCGGG
TCGCATTGACCTGCGGTAACGCCAGGTTTTCGCTACCGACGATGCCAGTCGAGGATTATCCGAC
GCTGCCGACGCTGCCGGAAGAGACCGGATTGTTGCCTGCGGAATTATTCGCCGAGGCAATCAG
TCAGGTCGCTATCGCCGCCGGCCGGGACGACACGTTGCCTATGTTGACCGGCATCCGGGTCGA
AATCCTCGGTGAGACGGTGGTTTTGGCCGCTACCGACAGGTTTCGCCTGGCTGTTCGAGAACTG
AAGTGGTCGGCGTCGTCGCCAGATATCGAAGCGGCTGTGCTGGTCCCGGCCAAGACGCTGGC
CGAGGCCGCCAAAGCGGGCATCGGCGGCTCTGACGTTCGTTTGTCGTTGGGTACTGGGCCGG
GGGTGGGCAAGGATGGCCTGCTCGGTATCAGTGGGAACGGCAAGCGCAGCACCACGCGACTT
CTTGATGCCGAGTTCCCGAAGTTTCGGCAGTTGCTACCAACCGAACACACCGCGGTGGCCACC
ATGGACGTGGCCGAGTTGATCGAAGCGATCAAGCTGGTTGCGTTGGTAGCTGATCGGGGCGCG
CAGGTGCGCATGGAGTTCGCTGATGGCAGCGTGCGGCTTTCTGCGGGTGCCGATGATGTTGGA
CGAGCCGAGGAAGATCTTGTTGTTGACTATGCCGGTGAACCATTGACGATTGCGTTTAACCCAA
CCTATCTAACGGACGGTTTGAGTTCGTTGCGCTCGGAGCGAGTGTCTTTCGGGTTTACGACTGC
GGGTAAGCCTGCCTTGCTACGTCCGGTGTCCGGGGACGATCGCCCTGTGGCGGGTCTGAATGG
CAACGGTCCGTTCCCGGCGGTGTCGACGGACTATGTCTATCTGTTGATGCCGGTTCGGTTGCCG
GGCTGA

>Rv0003 recF DNA replication and SOS induction TB.seq 3280:4434 MW:42181
>emb|AL123456|MTBH37RV:3280–4437, recF SEQ ID NO:2
GTGTACGTCCGTCATTTGGGGCTGCGTGACTTCCGGTCCTGGGCATGTGTAGATCTGGAATTGC
ATCCAGGGCGGACGGTTTTTGTTGGGCCTAACGGTTATGGTAAGACGAATCTTATTGAGGCACT
GTGGTATTCGACGACGTTAGGTTCGCACCGCGTTAGCGCCGATTTGCCGTTGATCCGGGTAGGT
ACCGATCGTGCGGTGATCTCCACGATCGTGGTGAACGACGGTAGAGAATGTGCCGTCGACCTC
GAGATCGCCACGGGGCGAGTCAACAAAGCGCGATTGAATCGATCATCGGTCCGAAGTACACGT
GATGTGGTCGGAGTGCTTCGAGCTGTGTTGTTTGCCCCTGAGGATCTGGGGTTGGTTCGTGGG
GATCCCGCTGACCGGCGGCGCTATCTGGATGATCTGGCGATCGTGCGTAGGCCTGCGATCGCT
GCGGTACGAGCCGAATATGAGAGGGTGTTGCGCCAGCGGACGGCGTTATTGAAGTCCGTACCT
GGAGCACGGTATCGGGGTGACCGGGGTGTGTTTGACACTCTTGAGGTATGGGACAGTCGTTTG
GCGGAGCACGGGGCTGAACTGGTGGCCGCCCGCATCGATTTGGTCAACCAGTTGGCACCGGA
AGTGAAGAAGGCATACCAGCTGTTGGCGCCGGAATCGCGATCGGCGTCTATCGGTTATCGGGC
CAGCATGGATGTAACCGGTCCCAGCGAGCAGTCAGATATCGATCGGCAATTGTTAGCAGCTCGG
CTGTTGGCGGCGCTGGCGGCCCGTCGGGATGCCGAACTCGAGCGTGGGGTTTGTCTAGTTGGT
CCGCACCGTGACGACCTAATACTGCGACTAGGCGATCAACCCGCGAAAGGATTTGCTAGCCATG
GGGAGGCGTGGTCGTTGGCGGTGGCACTGCGGTTGGCGGCCTATCAACTGTTACGCGTTGATG
```

TABLE 3-continued

```
GTGGTGAGCCGGTGTTGTTGCTCGACGACGTGTTCGCCGAACTGGATGTCATGCGCCGTCGAG
CGTTGGCGACGGCGGCCGAGTCCGCCGAACAGGTGTTGGTGACTGCCGCGGTGCTCGAGGAT
ATTCCCGCCGGCTGGGACGCCAGGCGGGTGCACATCGATGTGCGTGCCGATGACACCGGATC
GATGTCGGTGGTTCTGCCATGA

>Rv0005 gyrB DNA gyrase subunit B TB.seq 5123:7264 MW:78441
>emb|AL123456|MTBH37RV:5123-7267, gyrB SEQ ID NO:3
ATGGGTAAAAACGAGGCCAGAAGATCGGCCCTGGCGCCCGATCACGGTACAGTGGTGTGCGAC
CCCCTGCGGCGACTCAACCGCATGCACGCAACCCCTGAGGAGAGTATTCGGATCGTGGCTGCC
CAGAAAAAGAAGGCCCAAGACGAATACGGCGCTGCGTCTATCACCATTCTCGAAGGGCTGGAG
GCCGTCCGCAAACGTCCCGGCATGTACATTGGCTCGACCGGTGAGCGCGGTTTACACCATCTC
ATTTGGGAGGTGGTCGACAACGCGGTCGACGAGGCGATGGCCGGTTATGCAACCACAGTGAAC
GTAGTGCTGCTTGAGGATGGCGGTGTCGAGGTCGCCGACGACGGCCGCGGCATTCCGGTCGC
CACCCACGCCTCCGGCATACCGACCGTCGACGTGGTGATGACACAACTACATGCCGGCGGCAA
GTTCGACTCGGACGCGTATGCGATATCTGGTGGTCTGCACGGCGTCGGCGTGTCGGTGGTTAA
CGCGCTATCCACCCGGCTCGAAGTCGAGATCAAGCGCGACGGGTACGAGTGGTCTCAGGTTTA
TGAGAAGTCGGAACCCCTGGCCTCAAGCAAGGGGCGCCGACCAAGAAGACGGGGTCAACGG
TGCGGTTCTGGGCCGACCCCGCTGTTTTCGAAACCACGGAATACGACTTCGAAACCGTCGCCC
GCCGGCTGCAAGAGATGGCGTTCCTCAACAAGGGGCTGACCATCAACCTGACCGACGAGAGGG
TGACCCAAGACGAGGTCGTCGACGAAGTGGTCAGCGACGTCGCCGAGGCGCCGAAGTCGGCA
AGTGAACGCGCAGCCGAATCCACTGCACCGCACAAAGTTAAGAGCCGCACCTTTCACTATCCGG
GTGGCCTGGTGGACTTCGTGAAACACATCAACCGCACCAAGAACGCGATTCATAGCAGCATCGT
GGACTTTTCCGGCAAGGGCACCGGGCACGAGGTGGAGATCGCGATGCAATGGAACGCCGGGT
ATTCGGAGTCGGTGCACACCTTCGCCAACACCATCAACACCCACGAGGGCGGCACCCACGAAG
AGGGCTTCCGCAGCGCGCTGACGTCGGTGGTGAACAAGTACGCCAAGGACCGCAAGCTACTGA
AGGACAAGGACCCCAACCTCACCGGTGACGATATCCGGGAAGGCCTGGCCGCTGTGATCTCGG
TGAAGGTCAGCGAACCGCAGTTCGAGGGCCAGACCAAGACCAAGTTGGGCAACACCGAGGTCA
AATCGTTTGTGCAGAAGGTCTGTAACGAACAGCTGACCCACTGGTTTGAAGCCAACCCCACCGA
CGCGAAAGTCGTTGTGAACAAGGCTGTGTCCTCGGCGCAAGCCCGTATCGCGGCACGTAAGGC
ACGAGAGTTGGTGCGGCGTAAGAGCGCCACCGACATCGGTGGATTGCCCGGCAAGCTGGCCG
ATTGCCGTTCCACGGATCCGCGCAAGTCCGAACTGTATGTCGTAGAAGGTGACTCGGCCGGCG
GTTCTGCAAAAAGCGGTCGCGATTCGATGTTCCAGGCGATACTTCCGCTGCGCGGCAAGATCAT
CAATGTGGAGAAAGCGCGCATCGACCGGGTGCTAAAGAACACCGAAGTTCAGGCGATCATCAC
GGCGCTGGGCACCGGGATCCACGACGAGTTCGATATCGGCAAGCTGCGCTACCACAAGATCGT
GCTGATGGCCGACGCCGATGTTGACGGCCAACATATTTCCACGCTGTTGTTGACGTTGTTGTTC
CGGTTCATGCGGCCGCTCATCGAGAACGGGCATGTGTTTTTGGCACAACCGCCGCTGTACAAAC
TCAAGTGGCAGCGCAGTGACCCGGAATTCGCATACTCCGACCGCGAGCGCGACGGTCTGCTGG
AGGCGGGGCTGAAGGCCGGGAAGAAGATCAACAAGGAAGACGGCATTCAGCGGTACAAGGGT
CTAGGTGAAATGGACGCTAAGGAGTTGTGGGAGACCACCATGGATCCCTCGGTTCGTGTGTTGC
GTCAAGTGACGCTGGACGACGCCGCCGCCGCCGACGAGTTGTTCTCCATCCTGATGGGCGAGG
ACGTCGACGCGCGGCGCAGCTTTATCACCCGCAACGCCAAGGATGTTCGGTTCCTGGATGTCTA
A

>Rv0006 gyrA DNA gyrase subunit A TB.seq 7302:9815 MW:92276
>emb|AL123456|MTBH37RV:7302-9818, gyrA SEQ ID NO:4
ATGACAGACACGACGTTGCCGCCTGACGACTCGCTCGACCGGATCGAACCGGTTGACATCGAG
CAGGAGATGCAGCGCAGCTACATCGACTATGCGATGAGCGTGATCGTCGGCCGCGCGCTGCCG
GAGGTGCGCGACGGGCTCAAGCCCGTGCATCGCCGGGTGCTCTATGCAATGTTCGATTCCGGC
TTCCGCCCGGACCGCAGCCACGCCAAGTCGGCCCGGTCGGTTGCCGAGACCATGGGCAACTA
CCACCCGCACGGCGACGCGTCGATCTACGACAGCCTGGTGCGCATGGCCCAGCCCTGGTCGC
TGCGCTACCCGCTGGTGGACGGCCAGGGCAACTTCGGCTCGCCAGGCAATGACCCACCGGCG
GCGATGAGGTACACCGAAGCCCGGCTGACCCCGTTGGCGATGGAGATGCTGAGGGAAATCGAC
GAGGAGACAGTCGATTTCATCCCTAACTACGACGGCCGGGTGCAAGAGCCGACGGTGCTACCC
AGCCGGTTCCCCAACCTGCTGGCCAACGGGTCAGGCGGCATCGCGGTCGGCATGGCAACCAAT
ATCCCGCCGCACAACCTGCGTGAGCTGGCCGACGCGGTGTTCTGGGCGCTGGAGAATCACGAC
GCCGACGAAGAGGAGACCCTGGCCGCGGTCATGGGGCGGGTTAAAGGCCCGGACTTCCCGAC
CGCCGGACTGATCGTCGGATCCCAGGGCACCGCTGATGCCTACAAAACTGGCCGCGGCTCCAT
TCGAATGCGCGGAGTTGTTGAGGTAGAAGAGGATTCCCGCGGTCGTACCTCGCTGGTGATCAC
CGAGTTGCCGTATCAGGTCAACCACGACAACTTCATCACTTCGATCGCCGAACAGGTCCGAGAC
GGCAAGCTGGCCGGCATTTCCAACATTGAGGACCAGTCTAGCGATCGGGTCGGTTTACGCATC
GTCATCGAGATCAAGCGCGATGCGGTGGCCAAGGTGGTGATCAATAACCTTTACAAGCACACCC
AGCTGCAGACCAGCTTTGGCGCCAACATGCTAGCGATCGTCGACGGGGTGCCGCGCACGCTGC
GGCTGGACCAGCTGATCCGCTATTACGTTGACCACCAACTCGACGTCATTGTGCGGCGCACCAC
CTACCGGCTGCGCAAGGCAAACGAGCGAGCCCACATTCTGCGCGGCCTGGTTAAAGCGCTCGA
CGCGCTGGACGAGGTCATTGCACTGATCCGGGCGTCGGAGACCGTCGATATCGCCCGGGCCG
GACTGATCGAGCTGCTCGACATCGACGAGATCCAGGCCCAGGCAATCCTGGACATGCAGTTGC
GGCGCCTGGCCGCACTGGAACGCCAGCGCATCATCGACGACCTGGCCAAAATCGAGGCCGAG
ATCGCCGATCTGGAAGACATCCTGGCAAAACCCGAGCGGCAGCGTGGGATCGTGCGCGACGAA
CTCGCCGAAATCGTGGACAGGCACGGCGACGACCGGCGTACCCGGATCATCGCGGCCGACGG
AGACGTCAGCGACGAGGATTTGATCGCCCGCGAGGACGTCGTTGTCACTATCACCGAAACGGG
ATACGCCAAGCGCACCAAGACCGATCTGTATCGCAGCCAGAAACGCGGCGGCAAGGGCGTGCA
GGGTGCGGGGTTGAAGCAGGACGACATCGTCGCGCACTTCTTCGTGTGCTCCACCCACGATTT
GATCCTGTTCTTCACCACCCAGGGACGGGTTTATCGGGCCAAGGCCTACGACTTGCCCGAGGC
CTCCCGGACGGCGCGCGGGCAGCACGTGGCCAACCTGTTAGCCTTCCAGCCCGAGGAACGCA
TCGCCCAGGTCATCCAGATTCGCGGCTACACCGACGCCCCGTACCTGGTGCTGGCCACTCGCA
ACGGGCTGGTGAAAAAGTCCAAGCTGACCGACTTCGACTCCAATCGCTCGGGCGGAATCGTGG
CGGTCAACCTGCGCGACAACGACGAGCTGGTCGGTGCGGTGCTGTGTTCGGCCGGCGACGAC
CTGCTGCTGGTCTCGGCCAACGGGCAGTCCATCAGGTTCTCGGCGACCGACGAGGCGCTGCG
GCCAATGGGTCGTGCCACCTCGGGTGTGCAGGGCATGCGGTTCAATATCGACGACCGGCTGCT
```

TABLE 3-continued

GTCGCTGAACGTCGTGCGTGAAGGCACCTATCTGCTGGTGGCGACGTCAGGGGGCTATGCGAA
ACGTACCGCGATCGAGGAATACCCGGTACAGGGCCGCGGCGGTAAAGGTGTGCTGACGGTCAT
GTACGACCGCCGGCGCGGCAGGTTGGTTGGGGCGTTGATTGTCGACGACGACAGCGAGCTGT
ATGCCGTCACTTCCGGCGGTGGCGTGATCCGCACCGCGGCACGCCAGGTTCGCAAGGCGGGA
CGGCAGACCAAGGGTGTTCGGTTGATGAATCTGGGCGAGGGCGACACACTGTTGGCCATCGCG
CGCAACGCCGAAGAAAGTGGCGACGATAATGCCGTGGACGCCAACGGCGCAGACCAGACGGG
CAATTAA

>Rv0014c pknB serine-threonine protein kinase TB.seq 15593:17470 MW:66511
>emb|AL123456|MTBH37RV:c17470–15590, pknB SEQ ID NO:5
ATGACCACCCCTTCCCACCTGTCCGACCGCTACGAACTTGGCGAAATCCTTGGATTTGGGGGCA
TGTCCGAGGTCCACCTGGCCCGCGACCTCCGGTTGCACCGCGACGTTGCGGTCAAGGTGCTGC
GCGCTGATCTAGCCCGCGATCCCAGTTTTTACCTTCGCTTCCGGCGTGAGGCGCAAAACGCCG
CGGCATTGAACCACCCTGCAATCGTCGCGGTCTACGACACCGGTGAAGCCGAAACGCCCGCCG
GGCCATTGCCCTACATCGTCATGGAATACGTCGACGGCGTTACCCTGCGCGACATTGTCCACAC
CGAAGGGCCGATGACGCCCAAACGCGCCATCGAGGTCATCGCCGACGCCTGCCAAGCGCTGA
ACTTCAGTCATCAGAACGGAATCATCCACCGTGACGTCAAGCCGGCGAACATCATGATCAGCGC
GACCAATGCAGTAAAGGTGATGGATTTCGGCATCGCCCGCGCCATTGCCGACAGCGGCAACAG
CGTGACCCAGACCGCAGCAGTGATCGGCACGGCGCAGTACCTGTCACCCGAACAGGCCCGGG
GTGATTCCGTCGACGCCCGATCCGATGTCTATTCCTTGGGCTGTGTTCTTTATGAAGTCCTCACC
GGGGAGCCACCTTTCACCGGCGACTCACCCGTCTCGGTTGCCTACCAACATGTGCGCGAAGAC
CCGATCCCACCTTCGGCGCGGCACGAAGGCCTCTCCGCCGACCTGGACGCCGTCGTTCTCAAG
GCGCTGGCCAAAAATCCGGAAAACCGCTATCAGACAGCGGCGGAGATGCGCGCCGACCTGGTC
CGCGTGCACAACGGTGAGCCGCCCGAGGCGCCCAAAGTGCTCACCGATGCCGAGCGGACCTC
GCTGCTGTCGTCTGCGGCCGGCAACCTTAGCGGTCCGCGCACCGATCCGCTACCACGCCAGGA
CTTAGACGACACCGACCGTGACCGCAGCATCGGTTCGGTGGGCCGTTGGGTTGCGGTGGTCGC
CGTGCTCGCTGTGCTGACCGTCGTGGTAACCATCGCCATCAACACGTTCGGCGGCATCACCCG
CGACGTTCAAGTTCCCGACGTTCGGGGTCAATCCTCCGCCGACGCCATCGCCACACTGCAAAA
CCGGGGCTTCAAAATCCGCACCTTGCAGAAGCCGGACTCGACAATCCCACCGGACCACGTTAT
CGGCACCGACCCGGCCGCCAACACGTCGGTGAGTGCAGGCGACGAGATCACAGTCAACGTGT
CCACCGGACCCGAGCAACGCGAAATACCCGACGTCTCCACGCTGACATACGCCGAAGCGGTCA
AGAAACTGACTGCCGCCGGATTCGGCCGCTTCAAGCAAGCGAATTCGCCGTCCACCCCGGAAC
TGGTGGGCAAGGTCATCGGGACCAACCCGCCAGCCAACCAGACGTCGGCCATCACCAATGTGG
TCATCATCATCGTTGGCTCTGGTCCGGCGACCAAAGACATTCCCGATGTCGCGGGCCAGACCGT
CGACGTGGCGCAGAAGAACCTCAACGTCTACGGCTTCACCAAATTCAGTCAGGCCTCGGTGGA
CAGCCCCCGTCCCGCCGGCGAGGTGACCGGCACCAATCCACCCGCAGGCACCACAGTTCCGG
TCGATTCAGTCATCGAACTACAGGTGTCCAAGGGCAACCAATTCGTCATGCCCGACCTATCCGG
CATGTTCTGGGTCGACGCCGAACCACGATTGCGCGCGCTGGGCTGGACCGGGATGCTCGACAA
AGGGGCCGACGTCGACGCCGGTGGCTCCCAACACAACCGGGTCGTCTATCAAAACCCGCCGG
CGGGGACCGGCGTCAACCGGGACGGCATCATCACGCTGAGGTTCGGCCAGTAG >Rv0016c pbpA TB.seq 18762:20234 MW:51577
>emb|AL123456|MTBH37RV:c20234–18759 pbpA SEQ ID NO:6
ATGAACGCCTCTCTGCGCCGAATATCGGTGACCGTGATGGCGTTGATCGTGTTGCTACTGCTCA
ACGCGACCATGACGCAGGTCTTCACCGCCGACGGGCTGCGTGCCGATCCCCGCAACCAGCGA
GTGTTGCTCGACGAGTATTCACGGCAGCGCGGCCAGATCACCGCTGGTGGCCAACTGCTGGCG
TACTCGGTAGCCACCGACGGCCGCTTTCGTTTCCTGCGGGTCTATCCCAATCCTGAGGTGTACG
CGCCGGTTACCGGCTTCTACTCCCTGCGCTATTCCAGCACCGCCCTAGAACGAGCCGAGGACC
CGATATTGAACGGGTCCGACCGCCGTCTGTTCGGCCGCCGGCTGGCCGACTTCTTCACCGGTC
GCGACCCACGCGGCGGTAATGTCGATACCACGATCAACCCGCGCATTCAGCAAGCCGGCTGGG
ACGCGATGCAGCAAGGCTGCTACGGGCCCTGTAAGGGAGCGGTGGTCGCCCTTGAGCCATCAA
CCGGCAAGATTTTGGCGTTGGTGTCTTCTCCGTCCTACGACCCCAACCTGCTGGCGTCGCATAA
CCCCGAGGTGCAGGCGCAAGCCTGGCAGCGGCTTGGCGACAATCCCGCCTCTCCACTGACCAA
CCGTGCCATCTCTGAGACGTATCCACCGGGTTCGACTTTCAAAGTGATCACCACTGCGGCCGCG
CTGGCCGCCGGGGCCACCGAGACCGAACAGCTGACTGCGGCGCCCACAATTCCGTTGCCAGG
CAGCACCGCCCAGCTAGAGAACTACGGCGGTGCGCCGTGCGGGGACGAACCCACCGTGTCGC
TGCGTGAGGCATTCGTCAAATCATGCAACACCGCATTCGTCCAGCTGGGCATCCGCACCGGCG
CCGACGCCCTGCGCAGCATGGCGCGCGCGTTCGGTCTCGATAGCCCACCGCGCCCAACTCCG
CTGCAAGTGGCGGAATCAACCGTCGGGCCTATCCCGGACAGCGCCGCACTAGGGATGACCAGT
ATCGGCCAAAAGGACGTTGCGCTGACCCCGCTAGCGAACGCAGAAATAGCCGCGACCATCGCA
AACGGCGGCATTACGATGAGGCCTTATCTAGTCGGCAGCCTCAAGGGACCGGACCTAGCCAAT
ATCTCAACCACCGTCGGATACCAGCAGCGCCGCGCGGTGTCACCGCAGGTCGCCGCTAAGCTA
ACAGAGCTGATGGTCGGCGCCGAGAAAGTCGCACAGCAGAAAGGGGCAATCCCCGGCGTGCA
GATCGCATCCAAGACGGGCACCGCCGAACATGGCACCGACCCTCGTCACACTCCACCGCACGC
TTGGTACATCGCCTTTGCGCCCGCACAAGCGCCCAAGGTGGCTGTTGCCGTGCTGGTGGAGAA
CGGGGCTGATCGGCTGTCCGCCACCGGAGGTGCCCTCGCGGCACCGATCGGGCGGGCGGTG
ATCGAAGCCGCACTGCAGGGGGAACCATGA >Rv0017c rodA TB.seq 20234:21640 MW:50612
>emb|AL123456|MTBH37RV:c21640–20231, rodA SEQ ID NO:7
ATGACGACACGACTGCAAGCGCCGGTGGCCGTAACGCCCCCGTTGCCGACTCGGCGCAACGC
TGAACTGCTGCTGCTGTGCTTTGCCGCCGTAATCACGTTTGCCGCACTGCTGGTCGTGCAGGCC
AATCAAGACCAGGGGGTGCCCTGGGACTTGACTAGCTACGGACTGGCCTTCCTGACCCTGTTC
GGATCCGCGCATCTGGCCATCCGGCGCTTCGCCCCCTACACTGACCCGCTGTTGCTCCCGGTG
GTGGCACTGCTCAACGGACTTGGCCTGGTAATGATCCACCGCCTCGATCTGGTGGACAACGAG
ATCGGCGAGCATCGGCACCCCAGCGCAAACCAGCAGATGCTGTGGACGCTGGTGGGCGTAGC
TGCCTTCGCGCTCGTGGTGACCTTCCTCAAGGACCACCGACAGCTCGCACGCTACGGCTACATT
TGCGGGCTCGCGGGTCTGGTTTTCTTGGCAGTTCCCGCGCTGCTCCCGGCAGCACTGTCCGAA
CAGAACGGCGCCAAGATCTGGATCCGGTTGCCCGGCTTCTCGATTCAACCCGCCGAATTTTCAA TABLE 3-continued AGATTCTGCTGCTGATCTTCTTTTCGGCGGTACTGGTGGCCAAACGCGGCCTGTTCACCAGCGC
CGGCAAACATTTGCTCGGAATGACCCTGCCGCGCCCGCGAGACCTCGCGCCACTGTTGGCAGC
CTGGGTCATCTCGGTGGGTGTGATGGTCTTCGAGAAAGACCTCGGCGCTTCGCTGCTGCTGTAC
ACATCGTTTCTGGTGGTGGTTTACCTCGCCACCCAGCGGTTCAGTTGGGTCGTCATCGGCCTGA
CTCTGTTCGCGGCAGGAACCTTGGTGGCGTACTTCATTTTTGAGCACGTCCGGCTCCGCGTACA
GACCTGGCTGGATCCGTTCGCAGATCCAGACGGCACCGGATATCAGATCGTGCAGTCGCTTTTC
AGCTTCGCTACAGGCGGTATCTTCGGCACCGGGCTCGGTAATGGTCAACCCGACACCGTGCCC
GCGGCATCCACCGATTTCATCATCGCCGCGTTCGGCGAAGAGCTTGGGTTGGTGGGCTTGACG
GCCATCCTGATGCTCTACACCATCGTGATCATCCGGGGTTTGCGCACGGCCATCGCCACCCGC
GATAGCTTCGGCAAGCTGCTGGCCGCCGGCCTCTCATCGACGCTAGCCATTCAGCTGTTCATCG
TCGTCGGCGGTGTGACCCGACTCATTCCGCTGACCGGGTTGACCACACCGTGGATGTCCTACG
GCGGGTCTTCACTGCTGGCCAACTACATATTGCTGGCCATCCTGGCACGCATCTCGCACGGAGC
CCGCCGCCCACTGCGCACCCGCCCACGAAATAAGTCGCCGATTACGGCGGCCGGCACCGAGG
TCATCGAACGCGTATGA >Rv0018c ppp TB.seq 21640:23181 MW:53781
>emb|AL123456|MTBH37RV:c23181–21637, ppp SEQ ID NO:8
GTGGCGCGCGTGACCCTGGTCCTGCGATACGCGGCGCGCAGCGATCGCGGCTTGGTACGCGC
CAACAACGAAGACTCGGTCTACGCTGGGGCACGGCTATTGGCCCTGGCCGACGGCATGGGTG
GGCATGCGGCCGGCGAGGTGGCGTCCCAGTTGGTGATTGCCGCATTGGCCCATCTCGATGACG
ACGAGCCCGGTGGCGATCTGCTGGCCAAGCTGGATGCCGCGGTGCGCGCCGGCAACTCGGCT
ATCGCAGCGCAAGTCGAGATGGAGCCCGATCTCGAAGGCATGGGTACCACGCTCACCGCAATC
CTGTTCGCGGGCAACCGGCTCGGCCTGGTGCATATCGGTGACTCGCGCGGTTACCTGCTGCGC
GACGGTGAGCTGACGCAGATCACCAAGGACGACACGTTTGTCCAAACGCTGGTCGACGAAGGC
CGGATCACCCCGGAGGAGGCGCACAGCCACCCGCAACGCTCGTTGATCATGCGGGCGTTGAC
CGGCCATGAGGTCGAACCGACGCTGACCATGCGAGAAGCCCGCGCCGGTGATCGTTACCTGCT
GTGCTCGGACGGGTTGTCCGATCCGGTTAGCGATGAAACTATCCTCGAGGCCCTGCAGATCCC
CGAGGTTGCCGAGAGCGCTCACCGCCTCATTGAACTGGCGCTGCGCGGCGGCGGCCCCGACA
ACGTCACTGTCGTCGTCGCCGACGTCGTCGACTACGACTACGGCCAGACCCAACCGATTCTGG
CCGGGGCGGTCTCAGGCGACGACGACCAACTGACCCTGCCCAACACCGCCGCCGGCCGGGCC
TCTGCCATCAGCCAGCGCAAGGAGATCGTTAAACGCGTTCCGCCACAGGCCGATACATTCAGTC
GGCCACGGTGGTCGGGCCGACGGCTAGCATTCGTTGTCGCACTGGTGACCGTGCTGATGACTG
CGGGCCTGCTCATTGGTCGCGCGATCATCCGCAGCAACTACTACGTAGCGGACTACGCCGGCA
GCGTGTCCATCATGCGGGGGATTCAAGGGTCGCTACTGGGCATGTCCCTGCACCAGCCTTACC
TGATGGGCTGCCTCAGCCCGCGTAACGAGCTGTCGCAGATCAGCTACGGACAGTCTGGGGGCC
CTCTCGACTGCCATCTGATGAAACTGGAGGATCTGCGACCGCCGGAGCGCGCACAGGTTCGGG
CCGGTCTCCCGGCCGGCACTCTCGATGACGCCATCGGGCAGTTGCGCGAACTGGCGGCCAACT
CCCTGCTGCCGCCTTGCCCGGCGCCGCGTGCCACGTCCCCGCCCGGGCGCCCGGCCCCACCC
ACCACCAGCGAGACAACCGAACCAAACGTCACCTCCTCGCCAGCCTCTCCATCACCCACCACCT
CCGCGCCGGCCCCCACCGGAACTACTCCTGCCATCCCCACGAGTGCCTCCCCGGCAGCGCCC
GCGTCGCCGCCGACGCCTTGGCCCGTCACCAGCTCGCCGACGATGGCCGCACTTCCGCCACC
CCCGCCTCAGCCGGGCATCGACTGCCGGGCGGCGGCATGA >Rv0019c - TB.seq 23273:23737 MW:17153
>emb|AL123456|MTBH37RV:c23737–232700 Rv0019c SEQ ID NO:9
ATGCAGGGGTTGGTACTGCAACTGACGCGTGCCGGATTCTTGATGTTGTTGTGGGTATTCATCT
GGTCCGTGCTACGGATCTTGAAGACCGACATTTATGCGCCGACCGGCGCGGTCATGATGCGCC
GCGGCCTGGCGCTGCGAGGGACGCTCTTAGGCGCGCGTCAGCGCCGGCACGCTGCACGCTAC
CTGGTGGTGACCGAAGGTGCGTTGACTGGCGCGCGTATCACGCTGAGCGAACAGCCGGTGTTG
ATCGGGCGCGCCGACGACTCGACCCTGGTGCTGACCGACGACTACGCCTCGACGCGGCACGC
TCGGCTGTCTATGCGCGGCTCCGAGTGGTACGTCGAAGATCTAGGATCGACCAACGGCACTTA
CCTGGACAGGGCGAAGGTGACGACTGCGGTACGAGTTCCGATCGGAACGCCGGTTCGCATCG
GCAAAACTGCAATCGAGTTGCGCCCGTGA >Rv0020c - TB.seq 23864:25444 MW:56881
>emb|AL123456|MTBH37RV:c25444–23861, Rv0020c SEQ ID NO:10
ATGGGTAGCCAGAAAAGGCTGGTTCAGCGCGTTGAGCGCAAACTCGAGCAGACGGTTGGCGAT
GCGTTTGCCCGCATCTTTGGAGGCTCGATCGTCCCGCAAGAGGTCGAAGCCCTGCTGCGCCGC
GAGGCGGCCGACGGCATCCAGTCGCTGCAGGGAAATCGCCTTTTGGCGCCCAACGAATACATC
ATTACCCTCGGTGTGCACGACTTTGAGAAGTTGGGCGCTGATCCTGAGCTGAAGTCAACCGGTT
TTGCTCGGGACTTGGCGGACTATATCCAAGAACAGGGGTGGCAAACGTATGGTGATGTGGTCGT
CCGATTCGAGCAGTCGTCGAACCTGCATACCGGCCAGTTCCGCGCCCGCGGCACTGTTAACCC
CGACGTTGAGACCCACCCGCCGGTCATCGATTGCGCCCGGCCACAATCAAACCACGCGTTTGG
CGCAGAACCAGGAGTAGCACCAATGAGTGACAATTCGAGCTACCGTGGCGGTCAGGGGCAGGG
GCGTCCCGACGAGTATTACGACGACCGCTATGCGCGTCCGCAAGAGGATCCGCGTGGTGGCCC
GGATCCGCAAGGCGGATCTGACCCCCGCGGGGGTATCCACCCGAGACGGGCGGCTACCCGC
CCCAGCCGGGCTACCCACGCCCGCGCCACCCGGACCAGGGCGACTACCCCGAGCAAATCGGG
TACCCCGACCAGGGCGGTTACCCCGAGCAACGCGGTTACCCCGAGCAACGCGGCTACCCCGA
CCAGCGCGGGTACCAGGACCAGGGTCGAGGCTACCCCGACCAAGGGCAGGGGGGCTATCCGC
CGCCCTACGAGCAACGCCCTCCTGTTTCTCCCGGCCCGGCTGCCGGCTACGGCGCTCCCGGCT
ACGACCAGGGCTATCGCCAAAGCGGCGGCTACGGCCCTTCACCCGGTGGCGGCCAGCCCGGC
TACGGCGGGTACGGGGAGTACGGGCGTGGCCCGGCTCGCCACGAGGAGGGCAGCTATGTGCC
CTCTGGCCCTCCGGGCCCGCCCGAGCAACGACCGGCTTACCCCGACCAAGGCGGTTACGACC
AGGGCTACCAGCAAGGCGCCACGACATACGGCCGGCAAGACTATGGCGGCGGCGCTGACTAC
ACCCGCTACACCGAATCCCCGCGGGTCCCGGGATACGCTCCTCAGGGTGGCGGGTACGCCGA
ACCCGCCGGCCGAGACTACGACTACGGCCAATCAGGCGCTCCGGACTACGGTCAGCCAGCGC
CCGGTGGCTACAGCGGTTACGGGCAGGGCGGCTATGGGTCCGCCGGAACGTCGGTTACGCTG
CAGCTCGACGACGGCAGCGGACGCACTTACCAGCTCCGCGAGGGCTCCAACATCATCGGTCGC
GGACAGGACGCCCAGTTCCGGCTGCCCGACACCGGTGTGTCACGCCGTCACTTGGAGATCCG TABLE 3-continued GTGGGACGGGCAGGTCGCATTGCTCGCAGACCTGAACTCCACCAACGGCACCACTGTTAACAA
TGCACCGGTACAGGAGTGGCAGTTGGCCGACGGTGATGTGATCCGCTTGGGACACTCCGAGAT
CATCGTCCGCATGCACTGA >Rv0032 bioF2 C-terminal similar to *B. subtilis* BioF TB.seq 34295:36607 MW:86245
>emb|AL123456|MTBH37RV:34295–36610, bioF2 SEQ ID NO:11
ATGCCCACTGGCTTGGGCTATGACTTTCTGCGCCCTGTCGAGGACTCGGGGATCAACGACCTGA
AGCACTATTACTTCATGGCGGATTTGGCCGATGGGCAACCGCTAGGCCGGGCAAACCTCTATAG
CGTCTGTTTCGACCTGGCCACCACCGACCGCAAGCTCACTCCGGCCTGGCGAACGACCATCAA
ACGGTGGTTTCCGGGGTTTATGACCTTCCGTTTCCTCGAGTGCGGGTTGCTCACCATGGTGAGC
AACCCGCTGGCGTTGCGGTCCGACACCGACTTGGAGCGGGTATTGCCTGTGCTGGCCGGCCAG
ATGGACCAGTTGGCGCATGACGACGGGTCGGATTTCTTGATGATCCGGGACGTGGACCCGGAA
CACTACCAGCGATACCTTGACATCCTGCGCCCGTTGGGCTTTCGGCCTGCGCTGGGCTTTTCCC
GGGTAGACACGACCATCAGCTGGTCGAGCGTGGAAGAGGCACTGGGCTGCCTGTCTCACAAAA
GGCGCCTGCCGTTGAAGACGTCGCTGGAGTTTCGTGAGCGGTTCGGTATCGAGGTCGAGGAAC
TCGACGAGTATGCCGAGCATGCGCCGGTATTGGCCCGGCTTTGGCGCAACGTCAAGACGGAGG
CAAAGGATTACCAGCGCGAGGACCTGAACCCTGAGTTCTTCGCGGCGTGTTCTCGGCATCTGCA
TGGACGTAGCAGACTGTGGTTGTTCCGCTACCAGGGCACGCCAATTGCCTTCTTTTTGAACGTTT
GGGGTGCGGATGAGAACTACATACTGCTTGAGTGGGGCATCGATCGTGATTTTGAACATTATAG
GAAGGCGAATCTGTACCGGGCGGCGCTGATGCTCAGCCTAAAAGATGCGATCAGCCGAGATAA
ACGGCGAATGGAAATGGGTATTACGAACTATTTCACAAAACTTCGCATTCCGGGTGCCCGAGTC
ATACCGACCATCTATTTCCTGCGTCACAGCACGGATCCGGTGCATACGGCAACGTTAGCGCGAA
TGATGATGCACAATATTCAACGGCCAACGCTACCCGACGATATGTCGGAGGAATTCTGTCGCTG
GGAAGAGCGAATACGTCTGGACCAGGACGGGCTACCCGAACACGATATCTTTCGCAAGATCGAT
CGTCAGCACAAATACACGGGGCTCAAACTCGGCGGAGTCTACGGTTTTTATCCCCGATTCACCG
GACCGCAGCGATCCACGGTCAAGGCCGCGGAGCTGGGCGAGATCGTGTTGCTGGGCACGAAC
TCGTATCTGGGCCTGGCCACCCATCCAGAGGTGGTGGAGGCCTCGGCGGAGGCCACGCGACG
GTACGGCACCGGCTGCTCGGGTTCGCCGTTGCTGAACGGCACGTTGGACTTGCACGTCTCGCT
TGAGCAGGAACTAGCCTGTTTTTTGGGCAAACCCGCCGCCGTGTTGTGCTCCACCGGATATCAG
AGCAACCTGGCGGCGATCAGCGCGCTATGCGAATCCGGGGACATGATCATCCAAGACGCGCTG
AACCACCGCAGCCTGTTCGACGCCGCCAGGTTGTCCGGGGCCGACTTCACCTTGTACCGGCAC
AACGACATGGACCACCTGGCGCGGGTGCTACGCCGCACCGAGGGGCGCCGCCGGATCATCGT
CGTGGACGCGGTGTTCAGCATGGAAGGCACCGTCGCCGACCTGGCCACCATCGCCGAGCTTG
CCGACCGGCACGGCTGCCGGGTCTATGTGGACGAGTCCCATGCGCTGGGCGTGCTCGGCCCC
GACGGGCGAGGAGCTTCGGCCGCGTTGGGTGTCTTGGCGCGCATGGACGTGGTGATGGGCAC
GTTCAGCAAATCCTTTGCCTCCGTCGGCGGGTTCATCGCCGGAGATCGGCCCGTCGTGGACTA
CATCCGGCACAACGGTTCAGGTCATGTGTTTTCCGCCAGCCTGCCGCCGGCCGCCGCGGCTGC
CACCCACGCGGCTCTGCGCGTCAGTCGGCGTGAACCCGACCGGCGGGCTCGGGTGCTGGCCG
CGGCCGAGTACATGGCCACCGGCCTGGCACGGCAGGGCTATCAGGCCGAGTATCACGGAACC
GCGATCGTGCCGGTGATCCTGGGCAACCCGACCGTGGCGCATGCGGGCTATCTGCGGCTGAT
GCGCTCCGGGGTGTATGTGAACCCGGTGGCCCCCCAGCCGTGCCGGAGGAGCGTTCGGGAT
TCCGCACCAGCTACCTAGCCGACCACCGACAATCTGACCTCGACCGGGCCTTGCACGTGTTTGC
CGGCCTTGCCGAGGACCTGACCCCGCAAGGAGCCGCGCTATGA >Rv0050 ponA1 TB.seq 53661:55694 MW:71119
>emb|AL123456|MTBH37RV:53661–55697, ponA SEQ ID NO:12
GTGGTGATCCTGTTGCCGATGGTCACCTTCACGATGGCCTACCTGATCGTCGACGTTCCCAAGC
CAGGTGACATCCGTACCAACCAGGTCTCCACGATCCTTGCCAGCGACGGCTCGGAAATCGCCA
AAATTGTTCCGCCCGAAGGTAATCGGGTCGACGTCAACCTCAGCCAGGTGCCGATGCATGTGC
GCCAGGCGGTGATTGCGGCCGAAGACCGCAATTTCTATTCGAATCCGGGATTCTCGTTCACCGG
CTTCGCGCGGGCAGTCAAGAACAACCTGTTCGGCGGCGATCTGCAGGGCGGATCGACGATTAC
CCAGCAGTACGTCAAGAACGCGCTGGTCGGTTCCGCACAGCACGGGTGGAGCGGTCTGATGC
GCAAGGCGAAAGAATTGGTCATCGCGACGAAGATGTCGGGGGAGTGGTCTAAAGACGATGTGC
TGCAGGCGTATCTGAACATCATCTACTTCGGCCGGGGCGCCTACGGCATTTCGGCGGCGTCCA
AGGCTTATTTCGACAAGCCCGTCGAGCAGCTGACCGTTGCCGAAGGGGCGTTGTTGGCAGCGC
TGATTCGGCGGCCTTCGACGCTGGACCCGGCGGTCGACCCCGAAGGGGCCCATGCCCGCTGG
AATTGGGTACTCGACGGCATGGTGGAAACCAAGGCTCTCTCGCCGAATGACCGTGCGGCGCAG
GTGTTTCCCGAGACAGTGCCGCCCGATCTGGCCCGGGCAGAGAATCAGACCAAAGGACCCAAC
GGGCTGATCGAGCGGCAGGTGACAAGGGAGTTGCTCGAGCTGTTCAACATCGACGAGCAGACC
CTCAACACCCAGGGGCTGGTGGTCACCACCACGATTGATCCGCAGGCCCAACGGGCGGCGGA
GAAGGCGGTTGCGAAATACCTGGACGGGCAGGACCCCGACATGCGTGCCGCCGTGGTTTCCAT
CGACCCGCACAACGGGGCGGTGCGTGCGTACTACGGTGGCGACAATGCCAATGGCTTTGACTT
CGCTCAAGCGGGATTGCAGACTGGATCGTCGTTTAAGGTGTTTGCTCTGGTGGCCGCCCTTGAG
CAGGGGATCGGCCTGGGCTACCAGGTAGACAGCTCTCCGTTGACGGTCGACGGCATCAAGATC
ACCAACGTCGAGGGCGAGGGTTGCGGGACGTGCAACATCGCCGAGGCGCTCAAAATGTCGCT
GAACACCTCCTACTACCGGCTGATGCTCAAGCTCAACGGCGGCCCACAGGCTGTGGCCGATGC
CGCGCACCAAGCCGGCATTGCCTCCAGCTTCCCGGGCGTTGCGCACACGCTGTCCGAAGATGG
CAAGGGTGGACCGCCCAACAACGGGATCGTGTTGGGCCAGTACCAAACCCGGGTGATCGACAT
GGCATCGGCGTATGCCACGTTGGCCGCGTCCGGTATCTACCACCCGCCGCATTTCGTACAGAA
GGTGGTCAGTGCCAACGGCCAGGTCCTCTTCGACGCCAGCACCGCGGACAACACCGGCGATCA
GCGCATCCCCAAGGCGGTAGCCGACAACGTGACTGCGGCGATGGAGCCGATCGCAGGTTATTC
GCGTGGCCACAACCTAGCGGGTGGGCGGGATTCGGCGGCCAAGACCGGCACTACGCAATTTG
GTGACACCACCGCGAACAAAGACGCCTGGATGGTCGGGTACACGCCGTCGTTGTCTACGGCTG
TGTGGGTGGGCACCGTCAAGGGTGACGAGCCACTGGTAACCGCTTCGGGTGCAGCGATTTACG
GCTCGGGCCTGCCGTCGGACATCTGGAAGGCAACCATGGACGGCGCCTTGAAGGGCACGTCG
AACGAGACTTTCCCCAAACCGACCGAGGTCGGTGGTTATGCCGGTGTGCCGCCGCCGCCGCCG
CCGCCGGAGGTACCACCTTCGGAGACCGTCATCCAGCCCACGGTCGAAATTGCGCCGGGGATT
ACCATCCCGATCGGTCCCCCGACCACCATTACCCTGGCGCCACCGCCCCCGGCCCCGCCCGCT
GCGACTCCCACGCCGCCGCCGTGA TABLE 3-continued

```
>Rv0051 - TB.seq 55694:57373 MW:61210
>emb|AL123456|MTBH37RV:55694-57376, Rv0051 SEQ ID NO:13
GTGACCGGCGCGCTGTCCCAAAGCAGCAACATCTCGCCACTTCCTTTGGCCGCCGATCTGCGG
AGCGCCGATAACCGCGATTGCCCCAGCCGCACCGACGTATTGGGTGCCGCTCTGGCGAATGTC
GTCGGTGGCCCGGTAGGCCGGCACGCGCTGATCGGCCGCACCCGGCTGATGACCCCGCTGCG
GGTGATGTTTGCAATCGCGTTGGTGTTCCTGGCGCTCGGTTGGTCGACGAAAGCGGCCTGCTT
GCAGTCCACCGGAACCGGTCCAGGTGATCAGCGGGTGGCCAACTGGGATAACCAGCGTGCTTA
CTACCAGTTGTGCTACTCCGATACGGTGCCGCTCTATGGCGCTGAGTTATTGAGCCAAGGCAAG
TTTCCGTACAAATCAAGCTGGATCGAAACCGACAGCAACGGCACACCGCAGCTGCGCTACGAC
GGACAGATCGCGGTGCGCTATATGGAGTATCCGGTGCTGACTGGGATCTATCAGTACCTGTCGA
TGGCGATAGCCAAGACCTACACCGCGTTAAGCAAGGTGGCTCCCCTCCCGGTGGTTGCCGAAG
TGGTGATGTTCTTCAACGTCGCCGCGTTCGGTTTGGCGCTGGCGTGGCTGACAACCGTCTGGG
CGACCTCGGGCCTGGCCGGCCGCCGGATATGGGATGCGGCGCTGGTGGCCGCCTCACCGCTG
GTGATCTTTCAGATATTCACCAATTTCGATGCGCTGGCAACGGGTTTGGCGACGAGTGGGCTGC
TGGCCTGGGCGCGGCGCAGACCGGTGCTTGCCGGTGTGCTGATCGGGTTGGGCTCCGCGGCG
AAACTGTATCCGCTGTTGTTCTTGTACCCGTTGTTGCTGCTGGGCATCCGGGCCGGTCGCCTGA
ATGCTCTGGCCCGCACCATGGCGGCCGCGGCGGCGACCTGGTTGTTGGTGAATCTGCCGGTGA
TGCTGCTCTTTCCGCGCGGCTGGTCGGAGTTCTTCCGGCTCAACACCCGGCGCGGCGACGACA
TGGACTCGTTGTACAACGTCGTCAAGTCGTTCACCGGCTGGCGTGGCTTCGACCCCACCCTGG
GCTTCTGGGAGCCGCCGCTGGTGCTGAACACGGTTGTCACGCTCTTGTTCGTGTTATGTTGTGC
GGCAATTGCTTACATCGCGCTCACCGCACCCCACCGGCCGCGCGTGGCGCAGCTGACTTTCTT
GACGGTGGCCAGCTTCCTGTTGGTCAACAAGGTGTGGAGTCCCCAGTTCTCGCTTTGGCTGGTG
CCGCTGGCCGTGCTGGCTTTGCCGCACCGCCGGATCTTGCTGGCGTGGATGACGATCGACGCG
TTGGTGTGGGTGCCGCGGATGTACTACCTATACGGCAACCCGAGCCGCTCGCTGCCCGAGCAG
TGGTTCACCACGACGGTGTTGCTGCGTGACATCGCCGTGATGGTGCTGTGCGGACTGGTGGTC
TGGCAGATCTACCGCCCCGGGCGCGACCTCGTGCGTACCGGCGGGCCAGGGGCACTGCCGGC
TTGTGGGGGAGTCGACGACCCGGTGGGAGGGGTCTTTGCCAACGCCGCCGACGCCCCGCCAG
GTCGGCTACCGTCGTGGCTGCGTCCCCGGCTGGGCGACGAGCATGCGCGAGAGAGGACGCCC
GATGCAGGTCGCGATCGCACTTTTTCCGGGCAACACCGCGCTTGA

>Rv0106 - TB.seq 124372:125565 MW:43701
>emb|AL123456|MTBH37RV:124372-125568, Rv0106 SEQ ID NO:14
ATGCGTACTCCGGTGATATTGGTGGCAGGTCAGGATCACACCGACGAGGTGACGGGCGCCTTG
TTGCGCCGGACCGGAACGGTGGTCGTGGAGCACCGGTTTGACGGCCATGTGGTGCGACGGAT
GACTGCCACGCTGAGCCGTGGCGAATTGATCACCACGGAGGACGCTTTGGAGTTCGCCCACGG
CTGTGTGTCGTGCACAATCCGCGACGACCTGCTGGTGCTGTTACGCAGACTGCACCGCCGAGA
CAATGTCGGCCGGATCGTCGTGCACCTGGCGCCGTGGCTGGAGCCCCAGCCCATCTGCTGGG
CGATCGACCACGTGCGGGTTTGCGTCGGACACGGATACCCAGACGGACCAGCCGCCCTCGAC
GTGCGGGTCGCGGCCGTGGTGACCTGTGTGGACTGCGTAAGGTGGCTGCCGCAGTCACTCGG
CGAGGACGAACTGCCCGACGGGCGCACGGTGGCCCAAGTGACGGTCGGTCAGGCCGAGTTCG
CCGACCTTCTGGTGCTGACCCACCCGGAACCGGTCGCCGTGGCGGTTCTGCGCCGACTGGCC
CCTCGAGCGCGAATCACCGGCGGCGTCGACCGCGTCGAGCTGGCGCTGGCGCATCTGGACGA
CAACTCACGGAGGGGTCGTACCGATACCCCGCACACGCCATTGCTGGCGGGCCTGCCTCCGTT
GGCAGCCGACGGTGAGGTTGCGATCGTGGAATTCAGTGCCCGCCGCCCGTTTCACCCGCAACG
TCTGCATGCCGCGGTTGACCTGCTGCTCGATGGCGTGGTTCGCACTCGAGGTCGGCTGTGGCT
GGCCAACCGGCCGGATCAGGTCATGTGGCTCGAATCAGCCGGTGGCGGTCTGCGGGTCGCAT
CGGCCGGAAAGTGGTTGGCGGCGATGGCGGCCTCGGAGGTGGCCTATGTCGACCTGGAGCGG
CGGTTGTTCGCCGACCTGATGTGGGTCTACCCGTTCGGAGACCGGCACACCGCGATGACGGTA
CTGGTATGCGGCGCCGATCCGACCGACATCGTCAATGCCCTGAACGCGGCGCTGCTCAGCGAC
GACGAAATGGCATCTCCGCAACGCTGGCAGTCCTACGTCGACCCTTTCGGCGACTGGCATGAC
GACCCGTGCCACGAAATGCCCGATGCGGCTGGGGAATTCTCGGCACACCGCAACTCAGGAGAA
TCTCGATGA

>Rv0125 - TB.seq 151146:152210 MW:34927
>emb|AL123456|MTBH37RV:151146-152213, pepA SEQ ID NO:15
ATGAGCAATTCGCGCCGCCGCTCACTCAGGTGGTCATGGTTGCTGAGCGTGCTGGCTGCCGTC
GGGCTGGGCCTGGCCACGGCGCCGGCCCAGGCGGCCCCGCCGGCCTTGTCGCAGGACCGGT
TCGCCGACTTCCCCGCGCTGCCCCTCGACCCGTCCGCGATGGTCGCCCAAGTGGGGCCACAG
GTGGTCAACATCAACACCAAACTGGGCTACAACAACGCCGTGGGCGCCGGGACCGGCATCGTC
ATCGATCCCAACGGTGTCGTGCTGACCAACAACCACGTGATCGCGGGCGCCACCGACATCAAT
GCGTTCAGCGTCGGCTCCGGCCAAACCTACGGCGTCGATGTGGTCGGGTATGACCGCACCCAG
GATGTCGCGGTGCTGCAGCTGCGCGGTGCCGGTGGCCTGCCGTCGGCGGCGATCGGTGGCG
GCGTCGCGGTTGGTGAGCCCGTCGTCGCGATGGGCAACAGCGGTGGGCAGGGCGGAACGCC
CCGTGCGGTGCCTGGCAGGGTGGTCGCGCTCGGCCAAACCGTGCAGGCGTCGGATTCGCTGA
CCGGTGCCGAAGAGACATTGAACGGGTTGATCCAGTTCGATGCCGCGATCCAGCCCGGTGATT
CGGGCGGGCCCGTCGTCAACGGCCTAGGACAGGTGGTCGGTATGAACACGGCCGCGTCCGAT
AACTTCCAGCTGTCCCAGGGTGGGCAGGGATTCGCCATTCCGATCGGGCAGGCGATGGCGATC
GCGGGCCAGATCCGATCGGGTGGGGGGTCACCCACCGTTCATATCGGGCCTACCGCCTTCCTC
GGCTTGGGTGTTGTCGACAACAACGGCAACGGCGCACGAGTCCAACGCGTGGTCGGGAGCGC
TCCGGCGGCAAGTCTCGGCATCTCCACCGGCGACGTGATCACCGCGGTCGACGGCGCTCCGAT
CAACTCGGCCACCGCGATGGCGGACGCGCTTAACGGGCATCATCCCGGTGACGTCATCTCGGT
GACCTGGCAAACCAAGTCGGGCGGCACGCGTACAGGGAACGTGACATTGGCCGAGGGACCCC
CGGCCTGA

>Rv0350 dnaK 70 kD heat shock protein, chromosome replication TB.seq 419833:421707
MW:66832 SEQ ID NO:16
>emb|AL123456|MTBH37RV:419833-421710, dnaK
ATGGCTCGTGCGGTCGGGATCGACCTCGGGACCACCAACTCCGTCGTCTCGGTTCTGGAAGGT
```

TABLE 3-continued

```
GGCGACCCGGTCGTCGTCGCCAACTCCGAGGGCTCCAGGACCACCCCGTCAATTGTCGCGTTC
GCCCGCAACGGTGAGGTGCTGGTCGGCCAGCCCGCCAAGAACCAGGCAGTGACCAACGTCGA
TCGCACCGTGCGCTCGGTCAAGCGACACATGGGCAGCGACTGGTCCATAGAGATTGACGGCAA
GAAATACACCGCGCCGGAGATCAGCGCCCGCATTCTGATGAAGCTGAAGCGCGACGCCGAGGC
CTACCTCGGTGAGGACATTACCGACGCGGTTATCACGACGCCCGCCTACTTCAATGACGCCCAG
CGTCAGGCCACCAAGGACGCCGGCCAGATCGCCGGCCTCAACGTGCTGCGGATCGTCAACGA
GCCGACCGCGGCCGCGCTGGCCTACGGCCTCGACAAGGGCGAGAAGGAGCAGCGAATCCTGG
TCTTCGACTTGGGTGGTGGCACTTTCGACGTTTCCCTGCTGGAGATCGGCGAGGGTGTGGTTGA
GGTCCGTGCCACTTCGGGTGACAACCACCTCGGCGGCGACGACTGGGACCAGCGGGTCGTCG
ATTGGCTGGTGGACAAGTTCAAGGGCACCAGCGGCATCGATCTGACCAAGGACAAGATGGCGA
TGCAGCGGCTGCGGGAAGCCGCCGAGAAGGCAAAGATCGAGCTGAGTTCGAGTCAGTCCACCT
CGATCAACCTGCCCTACATCACCGTCGACGCCGACAAGAACCCGTTGTTCTTAGACGAGCAGCT
GACCCGCGCGGAGTTCCAACGGATCACTCAGGACCTGCTGGACCGCACTCGCAAGCCGTTCCA
GTCGGTGATCGCTGACACCGGCATTTCGGTGTCGGAGATCGATCACGTTGTGCTCGTGGGTGG
TTCGACCCGGATGCCCGCGGTGACCGATCTGGTCAAGGAACTCACCGGCGGCAAGGAACCCAA
CAAGGGCGTCAACCCCGATGAGGTTGTCGCGGTGGGAGCCGCTCTGCAGGCCGGCGTCCTCA
AGGGCGAGGTGAAAGACGTTCTGCTGCTTGATGTTACCCCGCTGAGCCTGGGTATCGAGACCA
AGGGCGGGGTGATGACCAGGCTCATCGAGCGCAACACCACGATCCCCACCAAGCGGTCGGAG
ACTTTCACCACCGCCGACGACAACCAACCGTCGGTGCAGATCCAGGTCTATCAGGGGGAGCGT
GAGATCGCCGCGCACAACAAGTTGCTCGGGTCCTTCGAGCTGACCGGCATCCCGCCGGCGCC
GCGGGGGATTCCGCAGATCGAGGTCACTTTCGACATCGACGCCAACGGCATTGTGCACGTCAC
CGCCAAGGACAAGGGCACCGGCAAGGAGAACACGATCCGAATCCAGGAAGGCTCGGGCCTGT
CCAAGGAAGACATTGACCGCATGATCAAGGACGCCGAAGCGCACGCCGAGGAGGATCGCAAGC
GTCGCGAGGAGGCCGATGTTCGTAATCAAGCCGAGACATTGGTCTACCAGACGGAGAAGTTCG
TCAAAGAACAGCGTGAGGCCGAGGGTGGTTCGAAGGTACCTGAAGACACGCTGAACAAGGTTG
ATGCCGCGGTGGCGGAAGCGAAGGCGGCACTTGGCGGATCGGATATTTCGGCCATCAAGTCG
GCGATGGAGAAGCTGGGCCAGGAGTCGCAGGCTCTGGGGCAAGCGATCTACGAAGCAGCTCA
GGCTGCGTCACAGGCCACTGGCGCTGCCCACCCCGGCGGCGAGCCGGGCGGTGCCCACCCC
GGCTCGGCTGATGACGTTGTGGACGCGGAGGTGGTCGACGACGGCCGGGAGGCCAAGTGA

>Rv0351 grpE stimulates DnaK ATPase activity TB.seq 421707:422411 MW:24501
>emb|AL123456|MTBH37RV:421707–422414, grpE SEQ ID NO:17
GTGACGGACGGAAATCAAAAGCCGGATGGCAATTCGGGCGAACAGGTAACCGTCACTGACAAG
CGGCGGATCGATCCCGAGACGGGTGAAGTGCGGCACGTCCCTCCCGGCGACATGCCGGGAGG
GACGGCTGCGGCCGATGCGGCGCACACCGAAGACAAGGTCGCCGAGCTGACCGCCGATCTGC
AACGCGTGCAGGCCGACTTCGCCAACTACCGTAAGCGGGCGTTGCGCGATCAGCAGGCGGCC
GCTGACCGAGCCAAGGCCAGCGTTGTCAGCCAATTGCTGGGTGTACTGGACGATCTCGAGCGG
GCGCGCAAGCACGGCGATTTGGAGTCGGGTCCACTGAAGTCGGTCGCCGACAAGCTAGACAGC
GCGTTGACCGGGCTGGGTCTGGTGGCGTTCGGTGCCGAGGGCGAGGATTTCGACCCCGTGCT
GCACGAAGCGGTGCAACACGAGGGCGACGGCGGGCAGGGGTCCAAGCCGGTAATCGGCACC
GTCATGCGGCAGGGCTACCAACTGGGTGAGCAGGTGCTGCGGCACGCCTTGGTCGGCGTCGT
CGACACGGTGGTCGTCGACGCGGCCGAACTGGAGTCAGTCGACGACGGCACTGCGGTCGCAG
ATACCGCCGAAAACGATCAAGCTGACCAGGGCAATAGCGCCGACACCTCGGGCGAACAGGCAG
AATCAGAACCGTCGGGCAGTTAA

>Rv0352 dnaJ acts with GrpE to stimulate DnaK ATPase TB.seq 422450:423634 MW:41346
>emb|AL123456|MTBH37RV:422450–423637, dnaJ SEQ ID NO:18
ATGGCCCAAAGGGAATGGGTCGAAAAAGACTTCTACCAGGAGCTGGGCGTCTCCTCTGATGCC
AGTCCTGAAGAGATCAAACGTGCCTATCGGAAGTTGGCGCGCGACCTGCATCCGGACGCGAAC
CCGGGCAACCCGGCCGCCGGCGAACGGTTCAAGGCGGTTTCGGAGGCGCATAACGTGCTGTC
GGATCCGGCCAAGCGCAAGGAGTACGACGAAACCCGCCGCCTGTTCGCCGGCGGCGGGTTCG
GCGGCCGTCGGTTCGACAGCGGCTTTGGGGGCGGGTTCGGCGGTTTCGGGGTCGGTGGAGAC
GGCGCCGAGTTCAACCTCAACGACTTGTTCGACGCCGCCAGCCGAACCGGCGGTACCACCATC
GGTGACTTGTTCGGTGGCTTGTTCGGACGCGGTGGCAGCGCCCGTCCCAGCCGCCCGCGACG
CGGCAACGACCTGGAGACCGAGACCGAGTTGGATTTCGTGGAGGCCGCCAAGGGCGTGGCGA
TGCCGCTGCGATTAACCAGCCCGGCGCCGTGCACCAACTGCCATGGCAGCGGGGCCCGGCCA
GGCACCAGCCCAAAGGTGTGTCCCACTTGCAACGGGTCGGGCGTGATCAACCGCAATCAGGGC
GCGTTCGGCTTCTCCGAGCCGTGCACCGACTGCCGAGGTAGCGGCTCGATCATCGAGCACCCC
TGCGAGGAGTGCAAAGGCACCGGCGTGACCACCCGCACCCGAACCATCAACGTGCGGATCCC
GCCCGGTGTCGAGGATGGGCAGCGCATCCGGCTAGCCGGTCAGGGCGAGGCCGGGTTGCGC
GGCGCTCCCTCGGGGGATCTCTACGTGACGGTGCATGTGCGGCCCGACAAGATCTTCGGCCGC
GACGGCGACGACCTCACCGTCACCGTTCCGGTCAGCTTCACCGAATTGGCTTTGGGCTCGACG
CTGTCGGTGCCTACCCTGGACGGCACGGTCGGGGTCCGGGTGCCCAAAGGCACCGCTGACGG
CCGCATTCTGCGTGTGCGCGGACGCGGTGTGCCCAAGCGCAGTGGGGGTAGCGGCGACCTAC
TTGTCACCGTGAAGGTGGCCGTGCCGCCCAATTTGGCAGGCGCCGCTCAGGAAGCTCTGGAAG
CCTATGCGGCGGCGGAGCGGTCCAGTGGTTTCAACCCGCGGGCCGGATGGGCAGGTAATCGC
TGA

>Rv0363c fba fructose bisphosphate aldolase TB.seq 441266:442297 MW:36545
>emb|AL123456|MTBH37RV:c442297–441263, fba SEQ ID NO:19
ATGCCTATCGCAACGCCCGAGGTCTACGCGGAGATGCTCGGTCAGGCCAAACAAAACTCGTAC
GCTTTCCCGGCTATCAACTGCACCTCCTCGGAAACCGTCAACGCCGCGATCAAAGGTTTCGCCG
ACGCCGGCAGTGACGGAATCATCCAGTTCTCGACCGGTGGCGCAGAATTCGGCTCCGGCCTCG
GGGTCAAAGACATGGTGACCGGTGCGGTCGCCTTGGCGGAGTTCACCCACGTTATCGCGGCCA
AGTACCCGGTCAACGTGGCGCTGCACACCGACCACTGCCCCAAGGACAAGTTGGACAGCTATG
TCCGGCCCTTGCTGGCGATCTCGGCGCAACGCGTGAGCAAAGGTGGCAATCCTTTGTTCCAGT
CGCACATGTGGGACGGCTCGGCAGTGCCAATCGATGAGAACCTGGCCATCGCCCAGGAGCTGC
TCAAGGCGGCGGCGGCCGCCAAGATCATTCTGGAGATCGAGATCGGCGTCGTCGGCGGCGAA
GAGGACGGCGTGGCGAACGAGATCAACGAGAAGCTGTACACCAGCCCGGAGGACTTCGAGAAA
```

TABLE 3-continued

ACCATCGAGGCGCTGGGCGCCGGTGAGCACGGCAAATACCTGCTGGCCGCGACGTTCGGCAA
CGTGCATGGCGTCTACAAGCCCGGCAACGTCAAGCTTCGCCCCGACATCCTTGCGCAAGGGCA
ACAGGTGGCGGCGGCCAAGCTCGGACTGCCGGCCGACGCCAAGCCGTTCGACTTCGTGTTCC
ACGGCGGCTCGGGTTCGCTTAAGTCGGAGATCGAGGAGGCGCTGCGCTACGGCGTGGTGAAG
ATGAACGTCGACACCGACACCCAGTACGCGTTCACCCGCCCGATCGCCGGTCACATGTTCACC
AACTACGACGGAGTGCTCAAGGTCGATGGCGAGGTGGGTGTCAAGAAGGTCTACGACCCGCGC
AGCTACCTCAAGAAGGCCGAAGCTTCGATGAGCCAGCGGGTCGTTCAGGCGTGCAATGACCTG
CACTGCGCCGGAAAGTCCCTAACCCACTAA

>Rv0405 pks6 TB.seq 485729:489934 MW:147615 >emb|AL123456|MTBH37RV:485729–489937,
pks6 SEQ ID NO:20
ATGACAGACGGTTCGGTCACTGCGGATAAGCTTCAAAAATGGTTTCGAGAGTACTTGTCCACGC
ATATCGAGTGTCATCCAAATGAGGTCAGCCTAGACGTTCCGATTAGAGATTTAGGTTTGAAATCG
ATTGATGTCTTAGCGATTCCCGGCGACCTCGGTGACAGATTTGGGTTTTGTATTCCCGATTTGGC
CGTTTGGGATAATCCTAGCGCTAATGATTTGATTGATAGTCTGTTGAACCAGCGTAGTGCTGACT
CGTTAAGAGAGAGTCATGGACACGCCGACAGGAACACGCAGGGTCGGGGCAGCATAAACGAGC
CGGTTGCGGTCATCGGAGTGGGCTGTCGATTTCCGGGAGATATTGACGGCCCGGAACGGCTAT
GGGACTTTCTGACCGAGAAGAAGTGTGCGATAACAGCGTATCCAGATCGTGGGTTCACGAATGC
TGGAACTTTCGCGGAGTCCGGAGGCTTTTTAAAGGATGTCGCGGGTTTCGATAATAGATTTTTTG
ATATCCCGCCGGACGAGGCTCTGCGAATGGATCCGCAACAACGGTTGTTACTGGAGGTCTCTTG
GGAAGCGTTAGAGCATGCAGGAATTATTCCTGAGTCATTAAGACTTTCACGTACGGGCGTATTC
GTTGGGGTGTCGTCAACTGACTACGTCCGGCTTGTGTCAGCTAGCGCTCAGCAAAAGTCTACTA
TTTGGGATAACACCGGCGGTTCTTCGAGTATTATTGCCAATAGAATCTCATACTTTCTCGATATTC
AGGGTCCGTCCATTGTCATTGACACGGCATGCTCGTCATCCCTGGTCGCCGTGCATCTAGCCTG
TCGAAGTCTCAGTACCTGGGACTGCGATATCGCACTTGTCGGTGGGACGAATGTTCTTATTTCAC
CAGAACCATGGGGTGGGTTTAGGGAAGCGGGCATCTTGTCGCAGACAGGCTGCTGTCACGCGT
TCGATAAATCCGCCGACGGGATGGTACGCGGTGAGGGATGCGGAGTTATCGTGCTGCAGCGCC
TCAGTGATGCACGCCTTGAGGGCCGGCGGATATTAGCGATTCTGACGGGTTCAGCGGTCAATC
AGGACGGTAAGTCCAACGGTATTATGGCGCCAAATCCTAGTGCGCAAATTGGTGTTCTTGAAAAT
GCATGCAAGAGCGCTCGCGTCGATCCGCTGGAAATCGGCTACGTCGAGGCCCACGGGACCGG
AACGTCGTTAGGGGATAGGATCGAGGCGCACGCCTTAGGCATGGTCTTTGGTCGCAAGAGACC
GGGATCTGGGCCCCTGATGATCGGGAGCATCAAGCCGAATATCGGCCATCTGGAAGGTGCGGC
TGGCATCGCCGGATTGATCAAGGCGGTGTTGATGGTTGAGCGTGGCTCGCTGCTTCCGAGCGG
GGGGTTTACGGAGCCAAATCCAGCTATCCCATTCACGGAATTGGGCCTGAGAGTTGTAGACGAA
CTTCAGGAGTGGCCGGTGGTGGCGGGTCGGCCGCGCCGGGCTGGGGTGTCATCGTTCGGCTT
TGGCGGCACCAATGCGCATGTGATTGTCGAGGAAGCTGGTTCGGTTGGGGCGGACACGGTTTC
GGGCCGCGCGGATGTTGGCGGTTCCGGTGGTGGGGTGGTGGCGTGGGTGATTTCGGGGAAGA
CGGCTTCGGCGTTGGCTGCTCAGGCGGGTCGGTTGGGGCGGTATGTGCGGGCTCGGCCGGCG
CTTGATGTTGTTGATGTGGGGTATTCGTTGGTGAGCACGCGGTCGGTGTTTGATCATCGGGCGG
TGGTGGTCGGCCAGACTCGCGATGAGTTGCTGGCTGGGTTGGCTGGGGTGGTTGCTGGTCGG
CCGGAGGCTGGGGTGGTCTGCGGTGTTGGCAAGCCGGCGGGCAAGACGGCTTTTGTGTTTGC
CGGTCAGGGCTCGCAGTGGCTGGGTATGGGTAGCGAGCTTTATGCTGCCTACCCGGTTTTCGC
CGAGGCCCTCGATGCTGTGGTGGACGAGTTGGACCGGCACCTGCGGTATCCGCTGCGCGATGT
GATCTGGGGGCACGACCAAGATCTGTTGAATACCACCGAATTCGCCCAGCCGGCGCTGTTTGC
GGTGGAGGTGGCGCTGTATCGGCTGCTCATGTCGTGGGGGGTGCGGCCGGGTTTGGTGCTGG
GTCATTCGGTGGGCGAGTTGGCCGCGGCGCACGTCGCCGGGGCGCTGTGTTTGCCGGATGCG
GCGATGCTGGTGGCCGCGCGTGGACGGTTGATGCAGGCGTTGCCCGCCGGCGGCGCCATGTT
TGCGGTGCAGGCCCGTGAAGACGAGGTAGCGCCGATGCTGGGGCACGATGTGAGCATCGCGG
CGGTCAATGGTCCGGCTTCGGTGGTGATCTCTGGTGCCCACGATGCGGTGAGCGCGATCGCTG
ATCGGCTGCGCGGCCAGGGCCGTCGGGTCCACCGGTTGGCGGTCTCGCATGCCTTTCACTCG
GCGTTGATGGAGCCGATGATCGCTGAGTTCACAGCCGTTGCGGCCGAACTGTCTGTGGGCTTG
CCCACGATCCCGGTCATTTCCAATGTGACCGGGCAGTTGGTGGCCGACGACTTCGCCTCAGCT
GATTACTGGGCCCGGCATATCCGGGCGGTGGTGCGGTTTGGCGACAGTGTTCGTAGTGCCCAC
TGCGCCGGTGCCAGTCGTTTCATCGAAGTCGGGCCCGGTGGCGGCTTGACGTCGTTGATCGAG
GCATCGCTGGCCGACGCGCAGATCGTGTCGGTGCCCACGCTGCGCAAAGATCGGCCCGAACC
GGTCAGTGTGATGACGGCGGCGGCCCAGGGCTTCGTCTCGGGGATGGGCCTGGATTGGGCCT
CGGTGTTTTCCGGGTACCGGCCCAAGCGGGTGGAGTTGCCGACGTATGCCTTCCAGCATCAAA
AGTTCTGGCTCGCACCAGCCCCATCGGTCAGCGACCCCACCGCCGCCGGCCAGATCGGGGCT
AGCGATGGTGGTGCTGAACTCTTGGCGTCCTCCGGGTTTGCCGCCCGGCTGGCCGGTCGGTCG
GCCGACGAGCAACTCGCCGCAGCGATCGAGGTGGTATGTGAGCATGCCGCAGCGGTGCTGGG
GCGCGACGGCGCTGCCGGACTCGACGCTGGCCAGGCGTTTGCCGATTCGGGATTTAATTCCTT
GAGTGCCGTGGAGCTACGTAACCGCTTAACAGCCGTCACCGCAGTAACGCTGCCGGCCACCGC
GATCTTCGATCACCCCACCCCGACCGAACTAGCCCAGTATCTGATCACCCAAATAGACGGTCAC
GGCAGCTCCGCCGCCGCAGCGGCAAACCCGGCGGAGCGAATCGATGCGCTCACCGATCTTTTT
CTACAAGCTTGCGATGCGGGTCGGGATGCCGATGGTTGGAAGATGGTCGCCCTGGCGTCGAAT
ACGCGCGAGCGCATGAGCTCACCGGTTCGGAACAACGTATCGAAGAACGTCGCACTGCTGGCA
GATGGTATCTCCGATGTGGTTGTAATTTGTATCCCAACTCTAACTGTGCTATCGGATCAGCGTGA
ATATCGAGATATTGCGAATGCGATGACAGGCCGCCATTCGGTTTATTCGCTTACGCTTCCCGGG
TTCGATTCGTCTGATGCACTGCCGCAAAACGCGGATATGATTGTTGAAACCGTATCTAACGCAAT
TATTGATGTGGTAGGCGGCAGCTGCCGTTTTGTGCTGTCGGGCTATTCATCGGGTGGGGTGTTG
GCCTATGCCCTCTGCTCCCATCTGTCGGTCAAGCACCAGCGGAATCCCCTCGGAGTCGCACTCA
TCGATACATATCTGCCTAGTCAGATCGCCAATCCTTCAATGAATGAAGGGTTCAGCCCCAACGAT
ACTGGGAAGGGCCTTTCCCGTGAAGTAATTCGAGTGGCCAGAATGTTGAATCGGTTAACTGCCA
CCCGACTCACCGCGGCAGCCACCTATGCTGCAATCTTTCAGGCCTGGGAACCAGGTAGATCAAT
GGCTCCGGTTCTTAACATCGTGGCGAAGGACCGAATAGCTACCGTCGAAAATTTACGCGAAGAA
CGAATCAACCGGTGGCGAACTGCTGCTGCAGAGGCGGCCTATTCTGTAGCCGAAGTACCCGGG
GATCATTTCGGAATGATGAGCACCTCGAGTGAGGCAATAGCTACCGAAATACATGATTGGATTTC
TGGGCTCGTTCGAGGGCCTCATCGGTAG TABLE 3-continued

```
>Rv0435c - ATPase of AAA-family TB.seq 522348:524531 MW:75315
>emb|AL123456|MTBH37RV:c524531—522345, Rv0435c SEQ ID NO:21
GTGACCCACCCGGACCCGGCCCGCCAACTCACCCTTACCGCCCGGCTGAACACCTCGGCCGTC
GACTCACGCCGCGGCGTCGTTCGGTTGCACCCCAATGCCATTGCTGCCCTTGGCATCCGCGAG
TGGGACGCGGTGTCGCTGACCGGCTCTCGGACAACCGCCGCGGTCGCCGGCCTGGCCGCGGC
AGACACCGCGGTCGGGACGGTGCTGCTCGATGACGTCACACTGTCCAATGCGGGCCTTCGCGA
AGGCACCGAGGTGATCGTCAGCCCGGTCACCGTCTACGGAGCGCGATCGGTGACGCTGAGCG
GTTCAACGCTGGCCACCCAGTCGGTGCCGCCGGTCACGCTGCGGCAGGCCCTACTCGGCAAG
GTGATGACCGTCGGTGACGCGGTCTCGCTGCTGCCCCGCGATCTAGGCCCCGGCACATCCACG
TCGGCTGCCAGCCGCGCATTGGCAGCTGCGGTCGGGATCAGTTGGACCTCGGAGCTGCTGACC
GTTACCGGCGTCGACCCCGACGGGCCGGTCAGCGTGCAGCCCAACTCGCTGGTCACCTGGGG
CGCTGGGGTCCCGGCCGCAATGGGTACGTCCACGGCCGGGCAAGTGAGCATCTCGAGTCCGG
AGATCCAGATCGAAGAGCTCAAGGGCGCCCAGCCGCAGGCTGCCAAGCTCACCGAATGGCTCA
AGCTTGCCCTCGATGAGCCGCACCTACTACAGACCTTGGGCGCCGGCACCAATTTGGGTGTGC
TGGTGTCGGGTCCGGCCGGGGTGGGCAAGGCGACGCTGGTGCGCGCGGTGTGCGACGGCCG
AAGGTTGGTGACACTGGATGGTCCGGAGATTGGAGCTCTGGCCGCCGGAGACCGGGTCAAAGC
CGTGGCCTCGGCAGTGCAGGCGGTTCGCCATGAGGGCGGTGTGTTGCTGATCACCGATGCCGA
CGCCCTGCTGCCAGCCGCCGCCGAGCCGGTAGCCTCGCTGATCCTGTCCGAGCTGCGTACCG
CGGTGGCCACCGCCGGTGTGGTATTGATCGCCACCTCAGCACGGCCCGATCAACTCGATGCCC
GGCTGCGTTCCCCCGAGTTGTGCGACCGGGAGCTTGGCCTGCCGCTGCCCGACGCGGCCACC
CGCAAATCGCTGCTGGAGGCGCTGCTGAATCCGGTTCCTACCGGAGACCTCAACCTCGACGAA
ATCGCCTCCCGCACACCGGGTTTCGTCGTGGCCGACCTGGCTGCGCTGGTTCGCGAGGCGGC
GCTGCGGGCAGCGTCTCGAGCCAGTGCCGACGGCCGACCACCGATGCTGCACCAAGACGACC
TCCTCGGTGCGTTGACCGTCATCCGGCCGCTGTCCCGCTCGGCCAGCGACGAAGTCACCGTGG
GTGACGTGACGCTCGACGATGTCGGTGACATGGCCGCGGCCAAACAAGCACTGACCGAGGCG
GTGCTGTGGCCGCTGCAGCACCCCGACACCTTCGCTCGGCTAGGTGTCGAACCGCCGCGCGG
GGTGTTGCTGTACGGCCCGCCCGGCTGCGGCAAGACCTTTGTGGTTCGTGCCCTGGCCAGCAC
CGGACAGTTGAGCGTGCATGCCGTCAAAGGGTCGGAGCTGATGGACAAGTGGGTGGGCTCCTC
GGAGAAGGCAGTCCGCGAGCTATTCCGGCGGGCCCGCGACTCCGCGCCGTCACTGGTGTTCC
TCGACGAGCTGGACGCTCTGGCGCCACGGCGCGGTCAGAGCTTCGACTCGGGCGTCTCCGAC
CGGGTGGTGGCCGCGCTGCTGACTGAGCTCGACGGTATTGACCCGCTGCGGGATGTCGTCATG
CTAGGCGCGACCAACCGGCCCGATCTGATAGACCCGGCGCTGCTGCGCCCGGGGCGGCTAGA
ACGGCTGGTGTTCGTTGAACCGCCCGACGCTGCCGCTCGCCGCGAAATCCTGCGCACCGCTGG
CAAGTCGATCCCGCTGAGCTCCGACGTCGACCTGGACGAGGTGGCAGCCGGACTCGACGGTTA
TAGTGCCGCCGACTGTGTGGCGCTGCTGCGCGAAGCCGCGCTTACCGCGATGCGGCGTTCCAT
CGATGCCGCCAACGTCACCGCCGCCGACCTGGCGACCGCGCGAGAAACCGTGCGCGCGTCGC
TGGATCCGCTGCAGGTGGCGTCGCTGCGTAAGTTCGGCACCAAGGGTGACCTTCGGTCCTAG

>Rv0436c pssA CDP-diacylglycerol-serine o-phosphatidyltransferase TB.seq 524531:525388
MW:31219 >emb|AL123456|MTBH37RV:c525388—524528, pssA SEQ ID NO:22
ATGATCGGAAAGCCCCGCGGCAGGCGAGGGGTAAACCTGCAGATACTGCCCAGCGCGATGAC
GGTGCTGTCCATTTGCGCGGGACTGACCGCAATCAAGTTTGCGCTCGAGCACCAGCCGAAGGC
CGCGATGGCACTGATCGCCGCAGCGGCCATCCTCGACGGGCTCGACGGCCGGGTGGCCCGCA
TCCTGGATGCCCAGTCGCGGATGGGCGCAGAGATCGACTCACTGGCCGACGCGGTGAACTTCG
GAGTGACACCCGCGCTGGTGCTTTACGTGTCGATGTTGTCGAAGTGGCCGGTCGGTTGGGTGG
TCGTGCTGCTCTACGCGGTGTGCGTGGTATTACGGCTGGCGCGGTACAACGCACTGCAGGACG
ACGGAACCCAGCCCGCCTACGCGCATGAATTCTTCGTCGGAATGCCCGCGCCGGCGGGCGCG
GTTTCCATGATCGGCCTGCTAGCCCTCAAAATGCAGTTCGGCGAAGGATGGTGGACCTCGGGCT
GGTTCCTCAGCTTTTGGGTGACGGGAACGTCGATACTCTTGGTCAGCGGGATCCCGATGAAAAA
GATGCACGCCGTGTCGGTACCACCCAACTACGCGGCCGCCCTGCTGGCGGTGCTGGCTATCTG
CGCGGCGGCCGCAGTCCTGGCCCCCTACTTGTTGATCTGGGTGATCATCATCGCCTACATGTGC
CATATTCCTTTCGCGGTGCGCAGCCAGCGCTGGCTTGCCCAACACCCTGAGGTGTGGGACGAC
AAGCCCAAGCAACGGCGCGCGGTGCGGCGCGCGAGCCGCCGGGCGCATCCCTACCGGCCGT
CGATGGCGCGGCTGGGCCTGCGCAAGCCGGGTCGACGGCTGTGA

>Rv0440 groEL 260 kD chaperonin 2 TB.seq 528606:530225 MW:56728
>emb|AL123456|MTBH37RV:528606—530228, groEL2 SEQ ID NO:23
ATGGCCAAGACAATTGCGTACGACGAAGAGGCCCGTCGCGGCCTCGAGCGGGGCTTGAACGC
CCTCGCCGATGCGGTAAAGGTGACATTGGGCCCCAAGGGCCGCAACGTCGTCCTGGAAAAGAA
GTGGGGTGCCCCCACGATCACCAACGATGGTGTGTCCATCGCCAAGGAGATCGAGCTGGAGGA
TCCGTACGAGAAGATCGGCGCCGAGCTGGTCAAAGAGGTAGCCAAGAAGACCGATGACGTCGC
CGGTGACGGCACCACGACGGCCACCGTGCTGGCCCAGGCGTTGGTTCGCGAGGGCCTGCGCA
ACGTCGCGGCCGGCGCCAACCCGCTCGGTCTCAAACGCGGCATCGAAAAGGCCGTGGAGAAG
GTCACCGAGACCCTGCTCAAGGGCGCCAAGGAGGTCGAGACCAAGGAGCAGATTGCGGCCAC
CGCAGCGATTTCGGCGGGTGACCAGTCCATCGGTGACCTGATCGCCGAGGCGATGGACAAGGT
GGGCAACGAGGGCGTCATCACCGTCGAGGAGTCCAACACCTTTGGGCTGCAGCTCGAGCTCAC
CGAGGGTATGCGGTTCGACAAGGGCTACATCTCGGGGTACTTCGTGACCGACCCGGAGCGTCA
GGAGGCGGTCCTGGAGGACCCCTACATCCTGCTGGTCAGCTCCAAGGTGTCCACTGTCAAGGA
TCTGCTGCCGCTGCTCGAGAAGGTCATCGGAGCCGGTAAGCCGCTGCTGATCATCGCCGAGGA
CGTCGAGGGCGAGGCGCTGTCCACCCTGGTCGTCAACAAGATCCGCGGCACCTTCAAGTCGGT
GGCGGTCAAGGCTCCCGGCTTCGGCGACCGCCGCAAGGCGATGCTGCAGGATATGGCCATTCT
CACCGGTGGTCAGGTGATCAGCGAAGAGGTCGGCCTGACGCTGGAGAACGCCGACCTGTCGC
TGCTAGGCAAGGCCCGCAAGGTCGTGGTCACCAAGGACGAGACCACCATCGTCGAGGGCGCC
GGTGACACCGACGCCATCGCCGGACGAGTGGCCCAGATCCGCCAGGAGATCGAGAACAGCGA
CTCCGACTACGACCGTGAGAAGCTGCAGGAGCGGCTGGCCAAGCTGGCCGGTGGTGTCGCGG
TGATCAAGGCCGGTGCCGCCACCGAGGTCGAACTCAAGGAGCGCAAGCACCGCATCGAGGAT
GCGGTTCGCAATGCCAAGGCCGCCGTCGAGGAGGGCATCGTCGCCGGTGGGGGTGTGACGCT
GTTGCAAGCGGCCCCGACCCTGGACGAGCTGAAGCTCGAAGGCGACGAGGCGACCGGCGCCA
ACATCGTGAAGGTGGCGCTGGAGGCCCCGCTGAAGCAGATCGCCTTCAACTCCGGGCTGGAGC
```

TABLE 3-continued

CGGGCGTGGTGGCCGAGAAGGTGCGCAACCTGCCGGCTGGCCACGGACTGAACGCTCAGACC
GGTGTCTACGAGGATCTGCTCGCTGCCGGCGTTGCTGACCCGGTCAAGGTGACCCGTTCGGCG
CTGCAGAATGCGGCGTCCATCGCGGGGCTGTTCCTGACCACCGAGGCCGTCGTTGCCGACAAG
CCGGAAAAGGAGAAGGCTTCCGTTCCCGGTGGCGGCGACATGGGTGGCATGGATTTCTGA

>Rv0482 murB TB.seq 570537:571643 MW:38522
>emb|AL123456|MTBH37RV:570537–571646, murB SEQ ID NO:24
ATGAAACGGAGCGGTGTCGGTTCGCTCTTTGCCGGTGCGCATATTGCCGAGGCGGTCCCGTTG
GCGCCGCTGACCACTTTGCGTGTGGGCCCGATCGCCCGACGTGTCATCACTTGCACCAGCGCC
GAACAGGTGGTGGCTGCGCTGCGGCACCTGGATTCGGCGGCCAAGACCGGAGCTGACCGCCC
GCTGGTGTTTGCTGGTGGCTCCAATTTGGTGATCGCCGAGAACCTGACCGACCTGACCGTGGT
GCGGTTGGCCAATAGCGGCATCACCATCGACGGTAACTTGGTGCGGGCCGAGGCCGGTGCGG
TCTTCGATGACGTGGTGGTTAGGGCCATCGAACAGGGTCTGGGCGGACTGGAATGCCTGTCTG
GCATCCCAGGATCGGCCGGGGCGACACCCGTGCAGAACGTGGGGGCGTATGGCGCGGAGGT
GTCTGACACCATCACTCGGGTTCGGCTTTTGGATCGGTGCACGGGTGAGGTGCGTTGGGTATC
CGCGCGCGACCTGCGCTTCGGCTATCGCACGAGCGTGCTCAAACACGCTGATGGGCTTGCGGT
GCCCACCGTGGTCTTGGAGGTGGAGTTTGCGCTGGATCCGTCGGGCCGCAGCGCACCGCTGC
GCTACGGCGAGCTGATCGCCGCGCTGAATGCGACCAGCGGCGAGCGCGCCGACCCGCAAGCG
GTCCGCGAAGCGGTGCTGGCCCTGCGGGCACGCAAGGGCATGGTGCTGGACCCGACCGACCA
TGACACCTGGAGCGTGGGATCGTTCTTCACAAACCCGGTGGTCACCCAGGATGTTTACGAACGG
CTGGCCGGTGACGCGGCCACCAGAAAGGACGGTCCGGTCCCGCACTATCCCGCGCCCGACGG
CGTCAAGCTGGCCGCCGGCTGGCTGGTGGAACGGGCCGGCTTCGGCAAGGGCTATCCGGATG
CCGGCGCCGCCCCATGCCGGCTTTCCACCAAACATGCGCTGGCGCTGACAAATCGTGGCGGG
GCCACCGCCGAAGATGTGGTGACGCTGGCGCGCGCCGTGCGCGATGGGGTCCATGATGTGTTT
GGTATCACACTAAAACCCGAACCCGTGCTGATCGGCTGCATGTTGTAG >Rv0483 - TB.seq 571708:573060 MW:47859
>emb|AL123456|MTBH37RV:571708–573063, Rv0483 SEQ ID NO:25
GTGGTCATTCGTGTGCTGTTTCGCCCGGTATCTTTGATACCCGTGAATAACTCCAGCACCCCCA
GAGTCAGGGGCCGATCAGTCGGCGTCTGGCGTTGACGGCCCTTGGGTTTGGGGTGTTGGCACC
GAACGTTCTGGTCGCGTGCGCCGGCAAAGTGACCAAGCTGGCCGAGAAGAGGCCGCCACCGG
CGCCTCGTCTGACTTTCCGGCCTGCCGACTCTGCCGCCGACGTGGTGCCGATCGCGCCGATCA
GCGTCGAGGTCGGTGACGGCTGGTTTCAGCGGGTCGCGCTGACCAATTCGGCAGGCAAGGTC
GTCGCCGGGGCATACAGCCGGGATCGCACCATCTACACGATCACCGAGCCGCTGGGCTACGAC
ACGACCTACACCTGGAGCGGTTCGGCCGTCGGCCATGACGGCAAGGCGGTTCCGGTGGCGGG
CAAGTTCACCACCGTGGCACCCGTCAAGACGATCAACGCGGGATTCCAGCTCGCCGACGGCCA
GACCGTCGGGATCGCGGCGCCGGTGATTATTCAGTTCGATTCACCGATCAGCGACAAGGCCGC
CGTCGAGCGGGCACTAACCGTGACCACCGACCCGCCTGTCGAGGGCGGCTGGGCCTGGCTGC
CCGACGAGGCGCAGGGCGCTCGCGTGCACTGGCGTCCTCGGGAGTACTACCCGGCGGGTACC
ACCGTCGACGTCGACGCCAAGCTGTATGGGCTGCCGTTCGGCGACGGCGCGTACGGCGCGCA
GGATATGTCGTTGCACTTCCAGATCGGTCGTCGTCAGGTGGTCAAGGCCGAAGTCTCGTCGCAC
CGCATCCAAGTCGTCACCGATGCCGGCGTCATCATGGACTTCCCGTGCAGCTACGGCGAGGCC
GACTTGGCGCGCAACGTCACCCGCAACGGCATCCACGTCGTCACCGAGAAATACTCGGACTTC
TACATGTCCAACCCGGCCGCCGGTTACAGCCATATCCACGAACGTTGGGCGGTGCGGATTTCC
AACAACGGCGAGTTCATCCATGCCAACCCTATGAGCGCCGGTGCCCAGGGCAACAGCAATGTC
ACCAACGGCTGTATCAACCTGTCGACGGAGAACGCCGAACAGTACTACCGCAGCGCGGTCTAC
GGTGACCCGGTTGAGGTGACCGGCAGTTCGATCCAGCTGTCCTACGCCGACGGTGACATCTGG
GACTGGGCGGTGGACTGGGACACCTGGGTGTCGATGTCGGCGCTACCGCCACCGGCGGCCAA
ACCGGCGGCGACGCAAATCCCGGTCACCGCCCCGGTCACGCCGTCGGATGCCCCCACCCCGT
CCGGCACACCCACGACTACTAACGGACCGGGTGGGTAG >Rv0489 gpm phosphoglycerate mutase I TB.seq 578424:579170 MW:27217
>emb|AL123456|MTBH37RV:578424–579173, gpm SEQ ID NO:26
ATGGCAAACACTGGCAGCCTGGTGTTGCTGCGCCACGGCGAGAGCGACTGGAATGCCCTCAAC
CTGTTCACCGGCTGGGTCGATGTCGGCCTGACGGACAAGGGCCAGGCAGAGGCGGTTCGAAG
CGGCGAGCTGATCGCGGAACACGACCTATTGCCCGACGTGCTCTACACCTCGTTGCTGCGGCG
CGCGATCACCACCGCGCATCTGGCGTTGGACAGCGCCGATCGGCTCTGGATTCCCGTGCGGCG
TAGCTGGCGGCTCAACGAACGCCACTACGGCGCGCTGCAGGGTTTGGACAAGGCCGAGACCAA
GGCCCGCTATGGCGAAGAGCAGTTCATGGCCTGGCGGCGCAGCTATGACACGCCGCCGCCGC
CGATCGAGCGGGGCAGTCAGTTCAGCCAGGACGCCGACCCTCGTTACGCCGACATCGGCGGT
GGCCCGCTCACCGAATGTCTGGCTGACGTGGTCGCCCGGTTTTTGCCATATTTCACCGACGTCA
TCGTTGGCGACTTGCGGGTCGGCAAGACGGTGCTGATCGTTGCCCACGGCAACTCGTTGCGCG
CGCTGGTCAAGCACCTGGACCAGATGTCTGACGACGAAATCGTCGGACTGAACATCCCGACCG
GAATTCCGCTGCGCTACGACCTGGATTCCGCGATGAGGCCGCTGGTGCGCGGTGGTACGTATC
TGGACCCGGAGGCGGCAGCCGCCGGCGCCGCCGCGGTGGCCGGCCAGGGCCGCGGGTAA >Rv0490 senX 3sensor histidine kinase TB.seq 579347:580576 MW:44794
>emb|AL123456|MTBH37RV:579347–580579, senX3 SEQ ID NO:27
GTGACTGTGTTCTCGGCGCTGTTGCTGGCCGGGGTTTTGTCCGCGCTGGCACTGGCCGTCGGT
GGTGCTGTTGGAATGCGGCTGACGTCGCGGGTCGTCGAACAGCGCCAACGGGTGGCCACGGA
GTGGTCGGGAATCACGGTTTCGCAGATGTTGCAATGCATTGTCACGCTGATGCCGCTGGGCGC
CGCGGTGGTGGACACCCATCGCGACGTTGTCTACCTCAACGAACGGGCCAAAGAGCTAGGTCT
GGTGCGCGACCGCCAGCTCGATGATCAGGCCTGGCGGGCCGCCCGGCAGGCGCTGGGTGGT
GAAGACGTCGAGTTCGACCTGTCGCCGCGCAAGCGGTCGGCCACGGGTCGATCCGGGCTATC
AGTGCATGGGCATGCCCGGTTGCTGAGCGAGGAAGACCGCCGGTTCGCCGTGGTGTTCGTGCA
CGACCAGTCGGATTATGCGCGGATGGAGGCGGCTAGGCGTGACTTCGTGGCCAACGTCAGTCA
CGAGCTCAAGACGCCCGTCGGTGCCATGGCTCTACTCGCCGAGGCGCTGCTGGCGTCGGCCG
ACGACTCCGAAACCGTTCGGCGGTTCGCCGAGAAGGTGCTCATTGAGGCCAACCGGCTCGGTG
ACATGGTCGCCGAGTTGATCGAGCTATCCCGGCTACAGGGCGCCGAGCGGCTACCCAATATGA TABLE 3-continued CCGACGTCGACGTCGATACGATTGTGTCGGAAGCGATTTCACGCCATAAGGTGGCGGCCGACA
ACGCCGACATCGAAGTCCGCACCGACGCGCCCAGCAATCTGCGGGTGCTGGGCGACCAAACTC
TGCTGGTTACCGCACTGGCAAACCTGGTTTCCAATGCGATTGCCTATTCGCCGCGCGGGTCGCT
GGTGTCGATCAGCCGTCGCCGTCGCGGTGCCAACATCGAGATCGCCGTCACCGACCGGGGCA
TCGGCATCGCGCCGGAAGACCAGGAGCGGGTCTTCGAACGGTTCTTCCGGGGGGACAAGGCG
CGCTCGCGTGCCACCGGAGGCAGCGGACTCGGGTTGGCCATCGTCAAACACGTCGCGGCTAAT
CACGACGGCACCATCCGCGTGTGGAGCAAACCGGGAACCGGGTCAACGTTCACCTTGGCTCTT
CCGGCGTTGATCGAGGCCTATCACGACGACGAGCGACCCGAGCAGGCGCGAGAGCCCGAACT
GCGGTCAAACAGGTCACAACGAGAGGAAGAGCTGAGCCGATGA >Rv0500 proC pyrroline-5-carboxylate reductase TB.seq 590081:590965 MW:30172
>emb|AL123456|MTBH37RV:590081–590968, proC SEQ ID NO:28
ATGCTTTTCGGCATGGCAAGGATCGCGATTATCGGCGGCGGCAGCATCGGTGAGGCATTGCTG
TCGGGTCTGCTGCGGGCGGGCCGGCAGGTCAAAGACCTGGTAGTGGCCGAGCGGATGCCCGA
TCGCGCCAACTACCTGGCGCAGACCTATTCGGTGTTGGTGACGTCGGCGGCCGACGCGGTGGA
GAACGCGACGTTCGTCGTCGTCGCGGTCAAACCAGCCGACGTCGAGCCGGTGATCGCGGATCT
GGCGAACGCGACTGCGGCGGCCGAAAACGACAGTGCTGAGCAGGTGTTCGTCACCGTGGTAG
CGGGCATCACGATCGCGTATTTCGAATCCAAGCTACCGGCTGGGACGCCAGTGGTGCGTGCGA
TGCCGAACGCGGCGGCATTGGTGGGAGCGGGGGTTACAGCGCTGGCCAAAGGCCGCTTTGTC
ACCCCGCAACAGCTTGAGGAGGTCTCGGCCTTGTTCGACGCGGTCGGCGGCGTGCTGACCGTT
CCGGAATCGCAGTTGGACGCGGTGACCGCGGTGTCCGGCTCGGGTCCGGCCTATTTCTTTCTG
CTGGTCGAGGCCCTGGTGGATGCCGGAGTCGGGGTGGCTTGAGCCGTCAGGTGGCCACCGA
TCTCGCCCGCGCAGACAATGGCTGGCTCAGCGGCGATGCTGCTGGAGCGGATGGAGCAAGACC
AGGGTGGCGCCAATGGCGAGCTGATGGGGCTGCGCGTGGACCTTACCGCATCACGGCTGCGC
GCCGCGGTTACCTCGCCGGGCGGTACGACCGCCGCTGCGCTGCGGGAACTCGAACGCGGCG
GGTTTCGGATGGCTGTCGACGCGGCGGTTCAAGCCGCCAAAAGCCGCTCTGAGCAGCTCAGAA
TTACACCGGAATGA >Rv0528 - TB.seq 618303:619889 MW:57132
>emb|AL123456|MTBH37RV:618303–619892, Rv0528 SEQ ID NO:29
ATGTGGCGGTCGTTGACGTCGATGGGCACCGCGCTGGTGCTGCTGTTTTTGCTCGCGCTGGCT
GCCATACCCGGGGCCCTGCTGCCGCAGCGTGGCCTCAACGCCGCCAAGGTGGACGACTACCT
GGCCGCGCACCCACTCATCGGTCCGTGGCTGGACGAGCTGCAGGCCTTCGACGTGTTCTCCAG
CTTCTGGTTCACCGCCATCTACGTGCTGCTGTTCGTGTCCCTCGTCGGCTGTCTGGCCCCGCGG
ACGATCGAGCACGCCCGCAGCCTGCGGGCTACACCGGTCGCCGCCCCGCGCAACCTGGCCCG
GCTGCCCAAGCACGCCCACGCCCGGCTGGCCGGCGAGCCCGCCGCCCTGGCCGCCACCATCA
CGGGCCGGCTGCGCGGCTGGCGCAGCATCACCCGGCAACAAGGCGACAGCGTGGAAGTCTCC
GCCGAGAAGGGCTACCTGCGCGAGTTCGGCAACCTGGTGTTCCACTTCGCGCTGCTGGGTCTG
CTGGTGGCGGTGGCCGTCGGCAAGCTGTTCGGCTACGAGGGCAACGTGATCGTGATAGCCGA
CGGCGGACCCGGTTTTTGTTCGGCGTCGCCGGCCGCGTTCGACTCGTTTCGCGCCGGCAACAC
CGTCGACGGCACGTCGTTGCACCCGATCTGTGTGCGGGTCAACAACTTCCAAGCGCACTACCT
GCCGTCCGGGCAGGCCACCTCGTTCGCCGCCGACATCGACTATCAGGCCGACCCGGCCACTG
CTGACCTGATCGCCAACAGCTGGCGGCCCTACCGGCTGCAGGTCAATCACCCGCTGCGGGTCG
GCGGCGACCGGGTGTACCTGCAGGGCCACGGCTATGCGCCCACCTTCACCGTGACGTTCCCG
GACGGGCAGACCCGCACGTCGACCGTGCAGTGGCGACCCGACAACCCGCAGACCCTGCTGTC
GGCGGGCGTCGTGCGCATCGACCCGCCGGCCGGCAGCTACCCCAACCCCGACGAGCGTCGCA
AACACCAGATCGCCATCCAGGGCCTGCTGGCTCCCACCGAGCAGCTCGACGGCACCCTGCTGT
CGTCGCGTTTCCCCGCGCTCAATGCCCCGGCGGTGGCCATCGACATCTACCGCGGCGACACCG
GCCTGGACAGCGGGCGGCCCCAGTCGTTGTTCACCCTGGACCACCGGCTGATCGAGCAGGGC
CGGCTGGTCAAGGAAAAGCGGGTCAACCTGCGCGCCGGTCAGCAAGTCCGCATCGACCAAGG
CCCGGCGGCCGGCACGGTGGTCCGGTTCGACGGCGCGGTGCCGTTCGTCAACCTGCAGGTCT
CCCACGACCCCGGCCAGTCCTGGGTGCTGGTCTTCGCAATCACGATGATGGCGGGACTGCTGG
TGTCGCTGCTGGTGCGCAGGCGCCGGGTGTGGGCGCGGATCACGCCGACGACCGCGGGTACG
GTAAACGTCGAGCTGGGCGGCCTGACGCGCACCGACAACTCCGGGTGGGGCGCCGAGTTCGA
GCGGCTGACCGGGCGGTTGCTGGCGGGTTTTGAGGCGCGGTCCCCGGACATGGCCGAAGCGG
CCGCAGGGACCGGAAGGGACGTCGATTGA >Rv0667 rpoB [beta] subunit of RNA polymerase TB.seq 759805:763320 MW:129220
>emb|AL123456|MTBH37RV:759805–763323, rpoB SEQ ID NO:30
TTGGCAGATTCCCGCCAGAGCAAAACAGCCGCTAGTCCTAGTCCGAGTCGCCCGCAAAGTTCCT
CGAATAACTCCGTACCCGGAGCGCCAAACCGGGTCTCCTTCGCTAAGCTGCGCGAACCACTTG
AGGTTCCGGGACTCCTTGACGTCCAGACCGATTCGTTCGAGTGGCTGATCGGTTCGCCGCGCT
GGCGCGAATCCGCCGCCGAGCGGGGTGATGTCAACCCAGTGGGTGGCCTGGAAGAGGTGCTC
TACGAGCTGTCTCCGATCGAGGACTTCTCCGGGTCGATGTCGTTGTCGTTCTCTGACCCTCGTT
TCGACGATGTCAAGGCACCCGTCGACGAGTGCAAAGACAAGGACATGACGTACGCGGCTCCAC
TGTTCGTCACCGCCGAGTTCATCAACAACAACACCGGTGAGATCAAGAGTCAGACGGTGTTCAT
GGGTGACTTCCCGATGATGACCGAGAAGGGCACGTTCATCATCAACGGGACCGAGCGTGTGGT
GGTCAGCCAGCTGGTGCGGTCGCCCGGGGTGTACTTCGACGAGACCATTGACAAGTCCACCGA
CAAGACGCTGCACAGCGTCAAGGTGATCCCGAGCCGCGGCGCGTGGCTCGAGTTTGACGTCGA
CAAGCGCGACACCGTCGGCGTGCGCATCGACCGCAAACGCCGGCAACCGGTCACCGTGCTGC
TCAAGGCGCTGGGCTGGACCAGCGAGCAGATTGTCGAGCGGTTCGGGTTCTCCGAGATCATGC
GATCGACGCTGGAGAAGGACAACACCGTCGGCACCGACGAGGCGCTGTTGGACATCTACCGCA
AGCTGCGTCCGGGCGAGCCCCCGACCAAAGAGTCAGCGCAGACGCTGTTGGAAAACTTGTTCT
TCAAGGAGAAGCGCTACGACCTGGCCCGCGTCGGTCGCTATAAGGTCAACAAGAAGCTCGGGC
TGCATGTCGGCGAGCCCATCACGTCGTCGACGCTGACCGAAGAAGACGTCGTGGCCACCATCG
AATATCTGGTCCGCTTGCACGAGGGTCAGACCACGATGACCGTTCCGGGCGGCGTCGAGGTGC
CGGTGGAAACCGACGACATCGACCACTTCGGCAACCGCCGCCTGCGTACGGTCGGCGAGCTG
ATCCAAAACCAGATCCGGGTCGGCATGTCGCGGATGGAGCGGGTGGTCCGGGAGCGGATGAC
CACCCAGGACGTGGAGGCGATCACACCGCAGACGTTGATCAACATCCGGCCGGTGGTCGCCG TABLE 3-continued CGATCAAGGAGTTCTTCGGCACCAGCCAGCTGAGCCAATTCATGGACCAGAACAACCCGCTGTC
GGGGTTGACCCACAAGCGCCGACTGTCGGCGCTGGGGCCCGGCGGTCTGTCACGTGAGCGTG
CCGGGCTGGAGGTCCGCGACGTGCACCCGTCGCACTACGGCCGGATGTGCCCGATCGAAACC
CCTGAGGGGCCCAACATCGGTCTGATCGGCTCGCTGTCGGTGTACGCGCGGGTCAACCCGTTC
GGGTTCATCGAAACGCCGTACCGCAAGGTGGTCGACGGCGTGGTTAGCGACGAGATCGTGTAC
CTGACCGCCGACGAGGAGGACCGCCACGTGGTGGCACAGGCCAATTCGCCGATCGATGCGGA
CGGTCGCTTCGTCGAGCCGCGCGTGCTGGTCCGCCGCAAGGCGGGCGAGGTGGAGTACGTGC
CCTCGTCTGAGGTGGACTACATGGACGTCTCGCCCCGCCAGATGGTGTCGGTGGCCACCGCGA
TGATTCCCTTCCTGGAGCACGACGACGCCAACCGTGCCCTCATGGGGGCAAACATGCAGCGCC
AGGCGGTGCCGCTGGTCCGTAGCGAGGCCCCGCTGGTGGGCACCGGGATGGAGCTGCGCGC
GGCGATCGACGCCGGCGACGTCGTCGTCGCCGAAGAAAGCGGCGTCATCGAGGAGGTGTCGG
CCGACTACATCACTGTGATGCACGACAACGGCACCCGGCGTACCTACCGGATGCGCAAGTTTG
CCCGGTCCAACCACGGCACTTGCGCCAACCAGTGCCCCATCGTGGACGCGGGCGACCGAGTC
GAGGCCGGTCAGGTGATCGCCGACGGTCCCTGTACTGACGACGGCGAGATGGCGCTGGGCAA
GAACCTGCTGGTGGCCATCATGCCGTGGGAGGGCCACAACTACGAGGACGCGATCATCCTGTC
CAACCGCCTGGTCGAAGAGGACGTGCTCACCTCGATCCACATCGAGGAGCATGAGATCGATGC
TCGCGACACCAAGCTGGGTGCGGAGGAGATCACCCGCGACATCCCGAACATCTCCGACGAGGT
GCTCGCCGACCTGGATGAGCGGGGCATCGTGCGCATCGGTGCCGAGGTTCGCGACGGGGACA
TCCTGGTCGGCAAGGTCACCCCGAAGGGTGAGACCGAGCTGACGCCGGAGGAGCGGCTGCTG
CGTGCCATCTTCGGTGAGAAGGCCCGCGAGGTGCGCGACACTTCGCTGAAGGTGCCGCACGG
CGAATCCGGCAAGGTGATCGGCATTCGGGTGTTTTCCCGCGAGGACGAGGACGAGTTGCCGGC
CGGTGTCAACGAGCTGGTGCGTGTGTATGTGGCTCAGAAACGCAAGATCTCCGACGGTGACAA
GCTGGCCGGCCGGCACGGCAACAAGGGCGTGATCGGCAAGATCCTGCCGGTTGAGGACATGC
CGTTCCTTGCCGACGGCACCCCGGTGGACATTATTTTGAACACCCACGGCGTGCCGCGACGGA
TGAACATCGGCCAGATTTTGGAGACCCACCTGGGTTGGTGTGCCCACAGCGGCTGGAAGGTCG
ACGCCGCCAAGGGGGTTCCGGACTGGGCCGCCAGGCTGCCCGACGAACTGCTCGAGGCGCAG
CCGAACGCCATTGTGTCGACGCCGGTGTTCGACGGCGCCCAGGAGGCCGAGCTGCAGGGCCT
GTTGTCGTGCACGCTGCCCAACCGCGACGGTGACGTGCTGGTCGACGCCGACGGCAAGGCCA
TGCTCTTCGACGGGCGCAGCGGCGAGCCGTTCCCGTACCCGGTCACGGTTGGCTACATGTACA
TCATGAAGCTGCACCACCTGGTGGACGACAAGATCCACGCCCGCTCCACCGGGCCGTACTCGA
TGATCACCCAGCAGCCGCTGGGCGGTAAGGCGCAGTTCGGTGGCCAGCGGTTCGGGGAGATG
GAGTGCTGGGCCATGCAGGCCTACGGTGCTGCCTACACCCTGCAGGAGCTGTTGACCATCAAG
TCCGATGACACCGTCGGCCGCGTCAAGGTGTACGAGGCGATCGTCAAGGGTGAGAACATCCCG
GAGCCGGGCATCCCCGAGTCGTTCAAGGTGCTGCTCAAAGAACTGCAGTCGCTGTGCCTCAAC
GTCGAGGTGCTATCGAGTGACGGTGCGGCGATCGAACTGCGCGAAGGTGAGGACGAGGACCT
GGAGCGGGCCGCGGCCAACCTGGGAATCAATCTGTCCCGCAACGAATCCGCAAGTGTCGAGGA
TCTTGCGTAA >Rv0668 rpoC [beta]' subunit of RNA polymerase TB.seq 763368:767315 MW:146740
>emb|AL123456|MTBH37RV:763368–767318, rpoC SEQ ID NO:31
GTGCTCGACGTCAACTTCTTCGATGAACTCCGCATCGGTCTTGCTACCGCGGAGGACATCAGGC
AATGGTCCTATGGCGAGGTCAAAAAGCCGGAGACGATCAACTACCGCACGCTTAAGCCGGAGA
AGGACGGCCTGTTCTGCGAGAAGATCTTCGGGCCGACTCGCGACTGGGAATGCTACTGCGGCA
AGTACAAGCGGGTGCGCTTCAAGGGCATCATCTGCGAGCGCTGCGGCGTCGAGGTGACCCGC
GCCAAGGTGCGTCGTGAGCGGATGGGCCACATCGAGCTTGCCGCGCCCGTCACCCACATCTG
GTACTTCAAGGGTGTGCCCTCGCGGCTGGGGTATCTGCTGGACCTGGCCCCGAAGGACCTGGA
GAAGATCATCTACTTCGCTGCCTACGTGATCACCTCGGTCGACGAGGAGATGCGCCACAATGAG
CTCTCCACGCTCGAGGCCGAAATGGCGGTGGAGCGCAAGGCCGTCGAAGACCAGCGCGACGG
CGAACTAGAGGCCCGGGCGCAAAAGCTGGAGGCCGACCTGGCCGAGCTGGAGGCCGAGGGC
GCCAAGGCCGATGCGCGGCGCAAGGTTCGCGACGGCGGCGAGCGCGAGATGCGCCAGATCC
GTGACCGCGCGCAGCGTGAGCTGGACCGGTTGGAGGACATCTGGAGCACTTTCACCAAGCTGG
CGCCCAAGCAGCTGATCGTCGACGAAAACCTCTACCGCGAACTCGTCGACCGCTACGGCGAGT
ACTTCACCGGTGCCATGGGCGCGGAGTCGATCCAGAAGCTGATCGAGAACTTCGACATCGACG
CCGAAGCCGAGTCGCTGCGGGATGTCATCCGAAACGGCAAGGGGCAGAAGAAGCTTCGCGCC
CTCAAGCGGCTGAAGGTGGTTGCGGCGTTCCAACAGTCGGGCAACTCGCCGATGGGCATGGTG
CTCGACGCCGTCCCGGTGATCCCGCCGGAGCTGCGCCCGATGGTGCAGCTCGACGGCGGCCG
GTTCGCCACGTCCGACTTGAACGACCTGTACCGCAGGGTGATCAACCGCAACAACCGGCTGAA
AAGGCTGATCGATCTGGGTGCGCCGGAAATCATCGTCAACAACGAGAAGCGGATGCTGCAGGA
ATCCGTGGACGCGCTGTTCGACAATGGCCGCCGCGGCCGGCCCGTCACCGGGCCGGGCAACC
GTCCGCTCAAGTCGCTTTCCGATCTGCTCAAGGGCAAGCAGGGCCGGTTCCGGCAGAACCTGC
TCGGCAAGCGTGTCGACTACTCGGGCCGGTCGGTCATCGTGGTCGGCCCGCAGCTCAAGCTGC
ACCAGTGCGGTCTGCCCAAGCTGATGGCGCTGGAGCTGTTCAAGCCGTTCGTGATGAAGCGGC
TGGTGGACCTCAACCATGCGCAGAACATCAAGAGCGCCAAGCGCATGGTGGAGCGCCAGCGCC
CCCAAGTGTGGGATGTGCTCGAAGAGGTCATCGCCGAGCACCCGGTGTTGCTGAACCGCGCAC
CCACCCTGCACCGGTTGGGTATCCAGGCCTTCGAGCCAATGCTGGTGGAAGGCAAGGCCATTC
AGCTGCACCCGTTGGTGTGTGAGGCGTTCAATGCCGACTTCGACGGTGACCAGATGGCCGTGC
ACCTGCCTTTGAGCGCCGAAGCGCAGGCCGAGGCTCGCATTTTGATGTTGTCCTCCAACAACAT
CCTGTCGCCGGCATCTGGGCGTCCGTTGGCCATGCCGCGGCTGGACATGGTGACCGGGCTGT
ACTACCTGACCACCGAGGTCCCCGGGGACACCGGCGAATACCAGCCGGCCAGCGGGGATCAC
CCGGAGACTGGTGTCTACTCTTCGCCGGCCGAAGCGATCATGGCGGCCGACCGCGGTGTCTTG
AGCGTGCGGGCCAAGATCAAGGTGCGGCTGACCCAGCTGCGGCCGCCGGTCGAGATCGAGGC
CGAGCTATTCGGCCACAGCGGCTGGCAGCCGGGCGATGCGTGGATGGCCGAGACCACGCTGG
GCCGGGTGATGTTCAACGAGCTGCTGCCGCTGGGTTATCCGTTCGTCAACAAGCAGATGCACAA
GAAGGTGCAGGCCGCCATCATCAACGACCTGGCCGAGCGTTACCCGATGATCGTGGTCGCCCA
GACCGTCGACAAGCTCAAGGACGCCGGCTTCTACTGGGCCACCCGCAGCGGCGTGACGGTGT
CGATGGCCGACGTGCTGGTGCCGCCGCGCAAGAAGGAGATCCTCGACCACTACGAGGAGCGC
GCGGACAAGGTCGAAAAGCAGTTCCAGCGTGGCGCTTTGAACCACGACGAGCGCAACGAGGC
GCTGGTGGAGATTTGGAAGGAAGCCACCGACGAGGTCGGTCAGGCGTTGCGGGAGCACTACC
CCGACGACAACCCGATCATCACCATCGTCGACTCCGGCGCCACCGGCAACTTCACCCAGACTC TABLE 3-continued GAACGCTGGCCGGTATGAAGGGCCTGGTGACCAACCCGAAGGGTGAGTTCATCCCGCGTCCG
GTCAAGTCCTCCTTCCGTGAGGGCCTGACCGTGCTGGAGTACTTCATCAACACCCACGGCGCTC
GAAAGGGCTTGGCGGACACCGCGTTGCGCACCGCCGACTCCGGCTACCTGACCCGACGTCTG
GTGGACGTGTCCCAGGACGTGATCGTGCGCGAGCACGACTGCCAGACCGAGCGCGGCATCGT
CGTCGAGCTGGCCGAGCGTGCACCCGACGGCACGCTGATCCGCGACCCGTACATCGAAACCTC
GGCCTACGCGCGGACCCTGGGCACCGACGCGGTCGACGAGGCCGGCAACGTCATCGTCGAGC
GTGGTCAAGACCTGGGCGATCCGGAGATTGACGCTCTGTTGGCTGCTGGTATTACCCAGGTCAA
GGTGCGTTCGGTGCTGACGTGTGCCACCAGCACCGGCGTGTGCGCGACCTGCTACGGGCGTT
CCATGGCCACCGGCAAGCTGGTCGACATCGGTGAAGCCGTCGGCATCGTGGCCGCCCAGTCC
ATCGGCGAACCCGGCACCCAGCTGACCATGCGCACCTTCCACCAGGGTGGCGTCGGTGAGGA
CATCACCGGTGGTCTGCCCCGGGTGCAGGAGCTGTTCGAGGCCCGGGTACCGCGTGGCAAGG
CGCCGATCGCCGACGTCACCGGCCGGGTTCGGCTCGAGGACGGCGAGCGGTTCTACAAGATC
ACCATCGTTCCTGACGACGGCGGTGAGGAAGTGGTCTACGACAAGATCTCCAAGCGGCAGCGG
CTGCGGGTGTTCAAGCACGAAGACGGTTCCGAACGGGTGCTCTCCGATGGCGACCACGTCGAG
GTGGGCCAGCAGCTGATGGAAGGCTCGGCCGACCCGCATGAGGTGCTGCGGGTGCAGGGCCC
CCGCGAGGTGCAGATACACCTGGTTCGCGAGGTCCAGGAGGTCTACCGCGCCCAAGGTGTGTC
GATCCACGACAAGCACATCGAGGTGATCGTTCGCCAGATGCTGCGCCGGGTGACCATCATCGA
CTCGGGCTCGACGGAGTTTTTGCCTGGCTCGCTGATCGACCGCGCGGAGTTCGAGGCAGAGAA
CCGCCGAGTGGTGGCCGAGGGCGGTGAGCCCGCGGCCGGCCGTCCGGTGCTGATGGGCATC
ACGAAGGCGTCGCTGGCCACCGACTCGTGGCTGTCGGCGGCGTCGTTCCAGGAGACCACTCG
CGTGCTGACCGATGCGGCGATCAACTGCCGCAGCGATAAGCTCAACGGTCTGAAGGAAAACGT
GATCATCGGCAAGCTGATCCCGGCCGGTACCGGTATCAACCGCTACCGCAACATCGCGGTGCA
GCCCACCGAGGAGGCCCGCGCTGCGGCGTACACCATCCCGTCGTATGAGGATCAGTACTACAG
CCCGGACTTCGGTGCGGCCACCGGTGCTGCCGTCCCGCTGGACGACTACGGCTACAGCGACTA
CCGCTAG >Rv0711 atsA TB.seq 806333:808693 MW:86216
>emb|AL123456|MTBH37RV:806333–808696, atsA SEQ ID NO:32
ATGGCACCCGAGGCCACCGAGGCGTTCAACGGCACCATCGAGCTGGATATTCGTGATTCGGAG
CCGGATTGGGGCCCATACGCAGCGCCGGTGGCACCGGAGCACTCACCAAACATCCTGTATCTG
GTCTGGGACGACGTCGGCATCGCGACCTGGGACTGCTTTGGCGGCCTGGTCGAGATGCCCGC
GATGACGCGCGTCGCCGAGCGTGGCGTGCGACTGTCGCAATTTCACACCACCGCACTGTGCTC
GCCGACCCGGGCGTCGCTGCTGACCGGTCGCAACGCCACCACCGTAGGCATGGCTACCATCG
AAGAGTTCACCGACGGGTTCCCCAACTGCAACGGGCGGATCCCGGCTGACACCGCGTTGCTCC
CAGAGGTGCTGGCCGAACATGGCTACAACACCTACTGTGTGGGCAAGTGGCACCTGACGCCAC
TCGAAGAATCCAATATGGCGTCGACGAAGCGGCACTGGCCGACCTCGCGTGGGTTCGAGCGGT
TCTACGGATTCCTAGGCGGGGAGACCGACCAGTGGTATCCCGACCTGGTATACGACAACCACC
CAGTGAGTCCTCCCGGCACACCCGAGGGTGGCTACCACCTGTCAAAAGACATCGCCGACAAGA
CGATCGAGTTCATTCGTGATGCCAAGGTGATCGCGCCCGACAAGCCGTGGTTCAGCTACGTGTG
CCCAGGCGCCGGGCATGCGCCGCACCACGTCTTCAAGGAATGGGCGGACAGATACGCCGGCC
GATTCGACATGGGGTATGAGCGCTATCGCGAGATCGTGCTGGAAAGGCAAAAGGCGCTAGGGA
TCGTGCCACCCGACACCGAACTGTCGCCCATAAACCCTTATCTGGATGTGCCGGGGCCAAACG
GCGAGACCTGGCCGCTGCAGGACACGGTGCGGCCGTGGGACTCGCTGAGCGATGAAGAAAAG
AAGCTGTTTTGCCGGATGGCCGAGGTGTTCGCCGGCTTTCTGAGCTACACCGACGCCCAGATC
GGACGGATCCTGGACTACCTCGAGGAATCCGGCCAGCTGGACAACACCATCATCGTGGTGATC
TCCGACAACGGCGCCAGCGGCGAGGGCGGACCCAACGGATCGGTCAACGAAGGCAAGTTCTT
CAACGGCTACATCGACACCGTCGCTGAAAGCATGAAGCTCTTCGACCACCTCGGTGGCCCGCA
GACCTACAACCACTACCCCATCGGGTGGGCAATGGCCTTCAACACCCCCTACAAGCTGTTCAAG
CGCTACGCCTCGCATGAAGGCGGCATTGCCGACCCGGCAATCATCTCCTGGCCCAACGGCATT
GCCGCACACGGTGAAATCCGCGACAACTACGTCAATGTCAGCGACATCACGCCCACCGTCTAC
GACCTGTTGGGCATGACACCGCCGGGGACCGTCAAGGGGATTCCGCAGAAACCGATGGACGG
CGTGAGCTTCATAGCGGCCCTTGCCGACCCGGCCGCCGACACCGGCAAGACCACCCAGTTCTA
CACCATGCTGGGCACCCGCGGGATCTGGCATGAAGGTTGGTTCGCCAACACCATTCACGCGGC
CACGCCCGCCGGCTGGTCGAATTTCAACGCTGACCGCTGGGAACTGTTCCACATCGCAGCAGA
CCGCAGCCAGTGCCACGACCTGGCCGCCGAGCATCCCGACAAACTTGAGGAGCTCAAGGCGCT
GTGGTTCTCCGAAGCCGCCAAGTACAACGGGCTGCCGCTGGCCGATCTGAACCTCCTGGAAAC
GATGACTCGGTCGCGGCCTTACCTGGTCAGCGAACGAGCCAGCTACGTCTACTATCCCGACTG
CGCTGACGTCGGCATCGGCGCGGCCGTAGAGATTCGCGGGCGCTCGTTCGCCGTGCTGGCCG
ATGTGACCATCGATACCACCGGCGCCGAGGGCGTGCTGTTCAAGCACGGCGGCGCCCATGGC
GGGCACGTGCTGTTCGTCCGGGACGGACGCTTGCACTACGTCTACAACTTCCTCGGTGAGCGC
CAGCAGCTGGTCAGCTCGTCGGGTCCGGTCCCGTCGGGAAGACATCTACTCGGGGTTCGTTAT
TTGCGGACCGGAACCGTGCCCAACAGTCACACGCCGGTGGGCGATCTTGAGCTGTTCTTCGAC
GAGAACCTGGTCGGCGCCCTGACCAATGTGCTGACCCACCCTGGAACGTTCGGGTTGGCCGGC
GCCGCTATCAGCGTTGGCCGCAACGGCGGTTCGGCTGTGTCCAGCCACTACGAAGCGCCGTTC
GCGTTCACCGGCGGTACCATCACCCAGGTCACCGTCGACGTGTCAGGCCGACCGTTCGAAGAT
GTGGAATCCGATCTTGCGCTTGCTTTTTCGCGTGACTGA >Rv0764c - lanosterol 14-demethylase cytochrome P450 TB.seq 856683:858035 MW:50879
>emb|AL123456|MTBH37RV:c858035–856680, Rv0764c SEQ ID NO:33
ATGAGCGCTGTTGCACTACCCCGGGTTTCGGGTGGCCACGACGAACACGGCCACCTCGAGGAG
TTCCGCACCGATCCGATCGGGCTGATGCAACGGGTCCGCGACGAATGCGGAGACGTCGGTACC
TTCCAGCTGGCCGGGAAGCAGGTCGTGCTGCTGTCCGGCTCGCACGCCAACGAATTCTTCTTC
CGGGCGGGCGACGACGACCTGGACCAGGCCAAGGCATACCCGTTCATGACGCCGATCTTCGG
CGAGGGCGTGGTGTTCGACGCCAGCCCGGAACGGCGTAAAGAGATGCTGCACAATGCCGCGC
TACGCGGCGAGCAGATGAAGGGCCACGCTGCCACCATCGAAGATCAAGTCCGACGGATGATCG
CCGACTGGGGTGAGGCCGGCGAGATCGATCTGCTGGACTTCTTCGCCGAGCTGACCATCTACA
CCTCCTCGGCCTGCCTGATCGGCAAGAAGTTCCGCGACCAGCTCGACGGGCGATTCGCCAAGC
TCTATCACGAGTTGGAGCGCGGCACCGACCCACTAGCCTACGTCGACCCGTATCTGCCGATCG
AGAGCTTCCGTCGCCGCGACGAAGCCCGCAATGGTCTGGTGGCACTGGTTGCGGACATCATGA TABLE 3-continued ACGGCCGGATCGCCAACCCACCCACCGACAAGAGCGACCGTGACATGCTCGACGTGCTCATCG
CCGTCAAGGCTGAGACCGGCACTCCCCGGTTCTCGGCCGACGAGATCACCGGCATGTTCATCT
CGATGATGTTCGCCGGCCATCACACCAGCTCGGGTACGGCTTCGTGGACGCTGATCGAGTTGA
TGCGCCATCGCGACGCCTACGCGGCCGTGATCGACGAACTCGACGAGCTGTACGGCGACGGC
CGATCGGTGAGTTTCCATGCGCTGCGCCAGATTCCGCAGCTGGAAAACGTGCTGAAAGAGACG
CTGCGCCTGCACCCTCCGCTGATCATCCTCATGCGAGTGGCCAAGGGCGAGTTCGAGGTGCAA
GGCCACCGGATTCATGAGGGCGATCTGGTGGCGGCCTCCCCGGCGATCTCCAACCGGATCCCC
GAAGACTTCCCCGATCCCCACGACTTCGTGCCAGCACGATACGAGCAGCCGCGCCAGGAAGAT
CTGCTCAACCGCTGGACGTGGATTCCGTTCGGCGCCGGCCGGCATCGTTGCGTGGGGGCGGC
GTTCGCCATCATGCAGATCAAAGCGATCTTCTCGGTGTTGTTGCGCGAGTATGAGTTTGAGATG
GCGCAACCGCCAGAAAGCTATCGTAACGACCATTCGAAGATGGTGGTGCAGTTGGCCCAGCCC
GCTTGCGTGCGCTACCGCCGGCGAACGGGAGTTTAA >Rv0861c - DNA helicase TB.seq 958524:960149 MW:59773
>emb|AL123456|MTBH37RV:c960149–958521, Rv0861c SEQ ID NO:34
GTGCAGTCCGATAAGACGGTGCTGTTGGAAGTCGACCATGAACTGGCCGGCGCTGCACGCGCC
GCCATCGCGCCGTTCGCCGAGCTGGAACGTGCACCCGAACATGTCCACACCTACCGCATCACA
CCGCTGGCACTGTGGAATGCTCGCGCCGCCGGCCATGATGCCGAGCAAGTCGTCGACGCGCT
GGTCAGTTACTCCCGCTACGCGGTGCCGCAACCCTTGCTCGTCGACATCGTCGACACCATGGC
CCGCTACGGACGACTGCAGTTGGTCAAGAACCCGGCCCATGGCCTGACGCTGGTGAGCCTGGA
CCGCGCGGTGCTTGAGGAAGTGCTGCGCAACAAGAAGATCGCGCCGATGCTTGGCGCCCGCAT
CGATGACGACACCGTCGTCGTCCACCCCAGCGAACGCGGCCGGGTCAAGCAGCTGCTGCTCAA
GATCGGTTGGCCCGCAGAGGATCTCGCCGGCTACGTCGATGGTGAAGCGCACCCGATCAGCCT
GCACCAGGAGGGCTGGCAGCTGCGCGATTACCAGCGGCTGGCCGCGGACTCGTTCTGGGCGG
GCGGCTCCGGGGTGGTGGTGCTGCCATGTGGGGCCGGCAAGACGCTGGTCGGTGCGGCCGC
AATGGCCAAAGCCGGCGCGACGACGTTGATCCTGGTCACCAATATCGTCGCGGCCCGGCAATG
GAAACGAGAGCTGGTCGCGCGCACCTCGCTCACCGAGAATGAGATCGGCGAATTCTCGGGAGA
ACGCAAGGAAATCCGACCTGTCACCATCTCGACATACCAGATGATCACCCGCCGCACTAAGGGC
GAGTACCGCCATCTGGAACTGTTCGACAGCCGCGACTGGGGGCTCATCATCTATGACGAGGTG
CACCTGTTGCCGGCACCGGTCTTCCGGATGACCGCTGACCTGCAGTCCAAACGGCGGCTGGGG
CTGACCGCCACGTTGATCCGTGAAGACGGACGCGAGGGCGACGTGTTTTCCCTTATCGGACCA
AAGCGCTATGACGCGCCGTGGAAGGACATTGAGGCGCAGGGCTGGATCGCGCCAGCTGAGTG
CGTGGAAGTCCGGGTCACGATGACCGACAGCGAGCGGATGATGTACGCCACCGCCGAACCCG
AAGAACGCTACCGGATCTGCTCGACGGTGCACACCAAAATTGCTGTGGTCAAGTCGATTCTGGC
GAAGCACCCGGATGAGCAGACCCTGGTCATCGGAGCGTACTTGGATCAGCTCGACGAGCTGGG
CGCCGAGCTCGGCGCTCCGGTGATTCAGGGGTCGACAAGGACCAGCGAACGCGAGGCACTGT
TCGACGCCTTCCGCCGCGGCGAGGTCGCTACGCTCGTGGTGTCCAAGGTGGCTAACTTCTCCA
TCGACTTGCCGGAAGCCGCCGTGGCGGTACAGGTTTCGGGAACATTCGGCTCACGCCAGGAAG
AGGCGCAACGGCTCGGCCGGATATTGCGACCCAAGGCCGACGGGGGCGGTGCCATCTTCTAC
TCGGTGGTGGCCCGCGACAGCCTGGATGCCGAGTACGCCGCACACCGGCAGCGGTTTTTAGCT
GAGCAGGGCTACGGTTACATCATCCGCGACGCCGACGACCTGCTGGGCCCGGCAATTTAG >Rv0904c accD3 TB.seq 1006694:1008178 MW:51741
>emb|AL123456|MTBH37RV:c1008178–1006691, accD3 SEQ ID NO:35
GTGAGTCGTATCACGACCGACCAACTGCGGCACGCGGTGCTAGACCGGGGATCTTTCGTCAGC
TGGGATAGCGAGCCGCTGGCGGTGCCGGTAGCCGACTCCTATGCGCGGGAGCTGGCCGCCGC
TCGGGCGGCCACCGGCGCGGACGAATCGGTGCAGACCGGTGAGGGACGCGTATTCGGGCGG
CGGGTGGCCGTGGTGGCCTGTGAGTTCGACTTCCTGGGCGGCTCGATTGGGGTGGCAGCGGC
CGAACGGATCACCGCCGCCGTCGAGCGGGCGACCGCCGAGCGGCTGCCGCTACTGGCGTCAC
CAAGCTCGGGAGGCACCCGCATGCAAGAAGGCACGGTCGCGTTTCTGCAGATGGTGAAGATCG
CTGCGGCCATCCAGCTGCACAACCAGGCGCGCCTGCCCTACCTGGTCTATTTGCGCCATCCGA
CCACGGGTGGAGTTTTCGCGTCGTGGGGCTCGCTGGGGCATCTCACCGTCGCCGAGCCGGGC
GCCCTGATCGGCTTTCTGGGACCACGGGTCTATGAGTTGCTCTATGGCGACCCCTTCCCATCCG
GCGTCCAAACCGCCGAGAATCTACGGCGGCATGGGATCATCGACGGCGTCGTTGCACTGGACC
GGCTACGACCGATGCTGGATCGTGCGTTGACGGTGCTCATCGACGCTCCCGAACCGCTTCCGG
CACCGCAGACGCCCGCGCCCGTACCCGATGTGCCCACGTGGGACTCGGTGGTGGCATCGCGC
CGGCCGGACCGGCCGGGCGTCAGGCAGCTACTGCGACACGGCGCCACCGACCGGGTGTTGTT
GTCAGGAACCGATCAAGGCGAAGCGGCGACCACGCTGCTGGCGCTGGCCCGCTTTGGCGGCC
AACCCACGGTGGTCCTCGGCCAGCAAAGGGCAGTAGGCGGCGGGGGAAGCACTGTCGGGCCC
GCTGCGTTACGCGAAGCCCGACGCGGGATGGCGCTCGCCGCCGAGCTGTGCCTGCCGCTGGT
GCTGGTCATTGACGCGGCCGGACCCGCGTTGTCGGCCGCAGCCGAACAGGGCGGGCTGGCCG
GCCAGATCGCGCATTGCCTGGCCGAGCTCGTCACGCTGGATACCCCGACCGTGTCGATCCTGC
TGGGCCAGGGCAGCGGCGGGCCGGCGCTGGCGATGTTGCCCGCCGACCGGGTGCTGGCCGC
ACTCCACGGCTGGCTGGCGCCCTTGCCTCCCGAAGGAGCCAGCGCGATCGTGTTCCGAGACAC
TGCTCATGCCGCCGAACTCGCTGCCGCCCAAGGCATCCGGTCGGCCGACCTACTGAAGTCGGG
GATTGTCGACACCATCGTGCCGGAGTACCCCGACGCCGCAGACGAGCCGATCGAGTTCGCCCT
ACGACTGTCGAACGCCATCGCCGCCGAAGTGCACGCGTTACGGAAGATACCGGCCCCGGAACG
CCTCGCGACTCGGTTGCAACGCTACCGCCGGATCGGGTTGCCCCGCGACTAA >Rv0983 - TB.seq 1099064:1100455 MW:46454
>emb|AL123456|MTBH37RV:1099064–1100458, Rv0983 SEQ ID NO:36
ATGGCCAAGTTGGCCCGAGTAGTGGGCCTAGTACAGGAAGAGCAACCTAGCGACATGACGAAT
CACCCACGGTATTCGCCACCGCCGCAGCAGCCGGGAACCCCAGGTTATGCTCAGGGGCAGCA
GCAAACGTACAGCCAGCAGTTCGACTGGCGTTACCCACCGTCCCCGCCCCCGCAGCCAACCCA
GTACCGTCAACCCTACGAGGCGTTGGGTGGTACCCGGCCGGGTCTGATACCTGGCGTGATTCC
GACCATGACGCCCCCTCCTGGGATGGTTCGCCAACGCCCTCGTGCAGGCATGTTGGCCATCGG
CGCGGTGACGATAGCGGTGGTGTCCGCCGGCATCGGCGGCGCGGCCGCATCCCTGGTCGGGT
TCAACCGGGCACCCGCCGGCCCCAGCGGCGGCCCAGTGGCTGCCAGCGCGGCGCCAAGCAT
CCCCGCAGCAAACATGCCGCCGGGGTCGGTCGAACAGGTGGCGGCCAAGGTGGTGCCCAGTG TABLE 3-continued TCGTCATGTTGGAAACCGATCTGGGCCGCCAGTCGGAGGAGGGCTCCGGCATCATTCTGTCTG
CCGAGGGGCTGATCTTGACCAACAACCACGTGATCGCGGCGGCCGCCAAGCCTCCCCTGGGC
AGTCCGCCGCCGAAAACGACGGTAACCTTCTCTGACGGGCGGACCGCACCCTTCACGGTGGTG
GGGGCTGACCCCACCAGTGATATCGCCGTCGTCCGTGTTCAGGGCGTCTCCGGGCTCACCCCG
ATCTCCCTGGGTTCCTCCTCGGACCTGAGGGTCGGTCAGCCGGTGCTGGCGATCGGGTCGCCG
CTCGGTTTGGAGGGCACCGTGACCACGGGGATCGTCAGCGCTCTCAACCGTCCAGTGTCGACG
ACCGGCGAGGCCGGCAACCAGAACACCGTGCTGGACGCCATTCAGACCGACGCCGCGATCAA
CCCCGGTAACTCCGGGGGCGCGCTGGTGAACATGAACGCTCAACTCGTCGGAGTCAACTCGGC
CATTGCCACGCTGGGCGCGGACTCAGCCGATGCGCAGAGCGGCTCGATCGGTCTCGGTTTTGC
GATTCCAGTCGACCAGGCCAAGCGCATCGCCGACGAGTTGATCAGCACCGGCAAGGCGTCACA
TGCCTCCCTGGGTGTGCAGGTGACCAATGACAAAGACACCCTGGGCGCCAAGATCGTCGAAGT
AGTGGCCGGTGGTGCTGCCGCGAACGCTGGAGTGCCGAAGGGCGTCGTTGTCACCAAGGTCG
ACGACCGCCCGATCAACAGCGCGGACGCGTTGGTTGCCGCCGTGCGGTCCAAAGCGCCGGGC
GCCACGGTGGCGCTAACCTTTCAGGATCCCTCGGGCGGTAGCCGCACAGTGCAAGTCACCCTC
GGCAAGGCGGAGCAGTGA >Rv1008 - Similar to *E. coli* protein YcfH TB.seq 1127087:1127878 MW:29066
>emb|AL123456|MTBH37RV:1127087–1127881, Rv1008 SEQ ID NO:37
TTGGTCGACGCCCACACCCATCTCGACGCGTGCGGTGCACGAGACGCCGATACGGTGCGGTC
GCTCGTCGAGCGAGCCGCCGCGGCCGGCGTGACCGCGGTGGTCACCGTCGCCGACGACCTG
GAGTCCGCGCGCTGGGTCACCCGCGCGGCCGAATGGGATCGGCGAGTCTATGCCGCGGTGGC
GTTGCACCCGACCCGCGCCGATGCGCTCACCGACGCTGCCCGTGCCGAGCTCGAGCGATTGG
TTGCCCACCCCAGGGTGGTGGCCGTCGGTGAGACCGGAATCGACATGTACTGGCCGGGTCGC
CTGGACGGGTGTGCGGAGCCGCACGTCCAGCGGGAGGCCTTTGCCTGGCATATCGATCTGGC
CAAGCGGACCGGTAAACCGCTGATGATCCACAATCGTCAGGCCGACCGCGACGTGCTGGACGT
GCTGCGGGCCGAGGGCGCGCCGGACACCGTGATCTTGCACTGCTTCTCGTCGGACGCGGCGA
TGGCCCGCACGTGTGTGGACGCCGGGTGGCTGCTCAGCCTGTCCGGGACGGTGAGCTTCCGT
ACCGCCCGTGAACTACGGGAAGCCGTCCCGCTGATGCCGGTGGAGCAGCTTTTGGTGGAAACC
GATGCACCGTATTTGACCCCGCATCCCCACCGGGGCTTGGCGAACGAACCGTACTGCCTGCCC
TATACCGTGCGGGCGCTGGCTGAACTGGTCAATCGGCGCCCCGAAGAGGTGGCGCTCATCACC
ACAAGCAACGCTCGCCGAGCTTATGGGCTAGGGTGGATGCGCCAATGA >Rv1009 - lipoprotein, similar to various other MTB proteins TB.seq 1128089:1129174 MW:38079
>emb|AL123456|MTBH37RV:1128089–1129177, Rv1009 SEQ ID NO:38
ATGTTGCGCCTGGTAGTCGGTGCGCTGCTGCTGGTGTTGGCGTTCGCCGGTGGCTATGCGGTC
GCCGCATGCAAAACGGTGACGTTGACCGTCGACGGAACCGCGATGCGGGTGACCACGATGAAA
TCGCGGGTGATCGACATCGTCGAAGAGAACGGGTTCTCAGTCGACGACCGCGACGACCTGTAT
CCCGCGGCCGGCGTGCAGGTCCATGACGCCGACACCATCGTGCTGCGGCGTAGCCGTCCGCT
GCAGATCTCGCTGGATGGTCACGACGCTAAGCAGGTGTGGACGACCGCGTCGACGGTGGACG
AGGCGCTGGCCCAACTCGCGATGACCGACACGGCGCCGGCCGCGGCTTCTCGCGCCAGCCGC
GTCCCGCTGTCCGGGATGGCGCTACCGGTCGTCAGCGCCAAGACGGTGCAGCTCAACGACGG
CGGGTTGGTGCGCACGGTGCACTTGCCGGCCCCCAATGTCGCGGGGCTGCTGAGTGCGGCCG
GCGTGCCGCTGTTGCAAAGCGACCACGTGGTGCCCGCCGCGACGGCCCCGATCGTCGAAGGC
ATGCAGATCCAGGTGACCCGCAATCGGATCAAGAAGGTCACCGAGCGGCTGCCGCTGCCGCCG
AACGCGCGTCGTGTCGAGGACCCGGAGATGAACATGAGCCGGGAGGTCGTCGAAGACCCGGG
GGTTCCGGGGACCCAGGATGTGACGTTCGCGGTAGCTGAGGTCAACGGCGTCGAGACCGGCC
GTTTGCCCGTCGCCAACGTCGTGGTGACCCCGGCCCACGAAGCCGTGGTGCGGGTGGGCACC
AAGCCCGGTACCGAGGTGCCCCCGGTGATCGACGGAAGCATCTGGGACGCGATCGCCGGCTG
TGAGGCCGGTGGCAACTGGGCGATCAACACCGGCAACGGGTATTACGGTGGTGTGCAGTTTGA
CCAGGGCACCTGGGAGGCCAACGGCGGGCTGCGGTATGCACCCCGCGCTGACCTCGCCACCC
GCGAAGAGCAGATCGCCGTTGCCGAGGTGACCCGACTGCGTCAAGGTTGGGGCGCCTGGCCG
GTATGTGCTGCACGAGCGGGTGCGCGCTGA >Rv1010 ksgA 16S rRNA dimethyltransferase TB.seq 1129150:1130100 MW:34647
>emb|AL123456|MTBH37RV:1129150–1130103, ksgA SEQ ID NO:39
ATGTGCTGCACGAGCGGGTGCGCGCTGACCATCCGGCTGCTCGGGCGCACTGAGATCAGGCG
GCTGGCCAAAGAGCTCGACTTTCGGCCGCGCAAATCTCTCGGACAGAACTTCGTGCACGACGC
CAACACGGTGCGACGGGTGGTTGCCGCCTCCGGGGTCAGCCGTTCCGACCTGGTTTTGGAGGT
CGGGCCGGGCCTGGGATCGCTGACCCTGGCACTGCTCGACCGCGGCGCGACCGTCACCGCGG
TCGAGATCGATCCACTACTGGCTTCTCGGCTGCAACAGACCGTGGCGGAGCACTCGCACAGCG
AGGTTCACCGACTAACGGTGGTCAATCGCGACGTCCTGGCCCTGCGCCGGGAGGATCTAGCCG
CGGCGCCGACCGCGGTGGTTGCCAATCTGCCGTACAACGTAGCGGTACCGGCGTTGTTGCATC
TGCTTGTCGAGTTCCCGTCGATCCGTGTCGTGACGGTGATGGTGCAGGCCGAGGTCGCCGAAC
GGCTCGCCGCCGAGCCGGGCAGCAAAGAGTACGGCGTGCCCAGCGTTAAGCTGCGCTTCTTC
GGGCGGGTTCGCCGCTGCGGCATGGTGTCGCCGACCGTTTTCTGGCCCATTCCGCGTGTCTAT
TCCGGGCTGGTACGCATCGATCGATATGAGACCTCGCCCTGGCCCACCGACGACGCTTTTCGA
CGGCGGGTATTCGAACTCGTGGACATCGCATTCGCGCAGCGGCGCAAGACTTCTCGCAACGCG
TTTGTGCAGTGGGCGGGCTCGGGAAGCGAGTCGGCGAATCGATTGTTGGCGGCCAGCATCGAC
CCCGCCCGTCGCGGTGAGACGCTGTCCATCGACGACTTCGTGCGGCTGCTGCGACGGTCCGG
CGGCTCCGACGAGGCCACCAGCACCGGCCGGGACGCCAGGGCGCCGGACATTTCGGGGCAC
GCGTCGGCGAGCTGA >Rv1011 - Homology to *E. coli* protein YcbH TB.seq 1130189:1131106 MW:31350
>emb|AL123456|MTBH37RV:1130189–1131109, Rv1011 SEQ ID NO:40
GTGCCCACCGGGTCGGTCACCGTTCGGGTGCCCGGAAAGGTCAACCTCTATCTGGCGGTCGGC
GATCGCCGCGAGGACGGCTATCACGAGCTGACCACGGTATTTCATGCCGTCTCGCTGGTCGAC
GAGGTAACCGTTCGTAACGCTGATGTGCTCTCGCTCGAGTTGGTCGGCGAGGGGGCCGACCAG
CTGCCGACCGACGAACGCAATCTCGCCTGGCAGGCGGCCGAGCTGATGGCCGAACACGTGGG
CCGGGCGCCGGACGTCTCGATCATGATCGACAAATCCATTCCGGTCGCCGGCGGCATGGCCG TABLE 3-continued

```
GTGGCAGCGCGGACGCTGCGGCGGTCCTGGTTGCGATGAACTCGTTGTGGGAACTCAATGTGC
CCCGCCGCGACCTGCGCATGCTCGCCGCGCGGCTAGGCAGCGATGTGCCGTTTGCCCTGCAT
GGTGGTACCGCGCTGGGGACGGGTCGCGGCGAGGAGTTGGCCACCGTGTTATCCCGCAACAC
CTTCCACTGGGTCCTGGCGTTCGCCGACAGCGGGTTGCTCACCTCCGCGGTGTACAACGAGCT
CGACCGGCTCAGGGAGGTGGGGGATCCGCCCCGGCTTGGTGAGCCCGGGCCGGTTCTGGCTG
CCTTAGCTGCGGGTGATCCGGATCAGCTGGCGCCGTTGCTGGGTAATGAAATGCAAGCGGCCG
CGGTGAGCCTGGACCCGGCGCTGGCTCGTGCGTTACGCGCCGGTGTGGAGGCCGGCGCGCTC
GCAGGCATCGTGTCCGGTTCGGGTCCCACGTGTGCCTTCCTGTGCACCTCGGCGAGCTCGGCG
ATCGATGTCGGCGCGCAGCTGTCGGGGGCGGAGTTTGTCGCACCGTTCGAGTCGCCACCGG
GCCGGTACCCGGCGCCCGCGTGGTGTCTGCGCCGACCGAAGTGTGA

>Rv1106c - cholesterol dehydrogenase TB.seq 1232845:1233954 MW:40743
>emb|AL123456|MTBH37RV:c1233954-1232842, Rv1106c SEQ ID NO:41
ATGCTTCGCCGCATGGGTGATGCATCGCTGACAACCGAGCTCGGCCGCGTTCTGGTCACCGGC
GGCGCGGGCTTCGTGGGCGCCAACCTGGTGACCACCTTGCTGGACCGCGGGCACTGGGTGCG
TTCCTTCGACCGCGCGCCGTCGCTGTTGCCTGCGCATCCGCAACTGGAGGTGCTGCAAGGGGA
CATCACCGACGCGGACGTCTGCGCCGCGGCCGTGGACGGCATCGACACGATCTTCCACACCG
CAGCGATCATCGAGCTGATGGGCGGCGCGTCGGTCACCGACGAGTACCGCCAACGTAGCTTTG
CGGTCAACGTCGGCGGCACCGAGAACCTGCTGCACGCCGGCCAGCGGGCCGGGGTGCAGCG
GTTCGTCTACACGTCATCCAACAGTGTGGTGATGGGCGGCCAGAACATCGCCGGCGGTGACGA
GACGCTGCCCTATACCGACCGGTTCAACGACCTCTACACCGAGACCAAGGTGGTTGCCGAGCG
ATTCGTGTTGGCCCAGAACGGTGTCGACGGCATGCTGACGTGCGCGATCCGGCCCAGCGGCAT
CTGGGGAAACGGCGATCAGACGATGTTCCGCAAGCTGTTCGAAAGTGTGCTCAAGGGCCACGT
CAAGGTGCTGGTCGGGCGCAAGTCGGCCCGGCTGGATAACTCTTACGTGCACAACCTGATTCA
CGGTTTCATCTTGGCCGCTGCCCATCTGGTGCCGGACGGCACAGCGCCCGGGCAGGCTTACTT
CATCAACGACGCAGAGCCGATCAATATGTTCGAGTTCGCTCGGCCGGTGCTCGAGGCGTGCGG
GCAGCGCTGGCCGAAGATGCGGATTTCCGGCCCCGCGGTCCGCTGGGTAATGACGGGGTGGC
AGCGGCTGCACTTCCGGTTCGGATTCCCCGCGCCGCTGCTCGAGCCGCTGGCCGTCGAACGAC
TGTACCTGGACAACTACTTTTCGATCGCTAAGGCACGCCGCGACCTGGGCTATGAGCCGCTGTT
CACCACCCAGCAGGCGCTGACCGAATGCCTGCCGTACTACGTGAGTCTGTTTGAGCAGATGAA
GAACGAGGCCCGGGCGGAAAAAACGGCCGCCACAGTCAAGCCGTAG

>Rv1110 lytB2 TB.seq 1236183:1237187 MW:36298
>emb|AL123456|MTBH37RV:1236183-1237190, lytB' SEQ ID NO:42
ATGGTTCCGACGGTCGACATGGGGATTCCCGGGGCTTCGGTATCGTCGCGATCGGTGGCCGAC
CGTCCCAACCGTAAGCGGGTGCTGCTGGCCGAGCCGCGTGGCTACTGCGCTGGCGTGGATCG
GGCCGTCGAAACGGTCGAACGCGCGCTTCAAAAACACGGCCCGCCTGTCTACGTGCGTCACGA
GATCGTGCATAACCGCCACGTGGTTGACACCCTGGCTAAGGCCGGTGCGGTTTTCGTCGAAGA
GACCGAGCAGGTTCCCGAGGGAGCGATTGTGGTGTTCTCCGCGCACGGGGTCGCGCCTACGG
TGCACGTCAGCGCCAGCGAGCGCAACCTGCAGGTCATTGACGCCACCTGCCCGCTGGTCACCA
AGGTGCACAACGAGGCCAGGCGGTTCGCCCGGGACGACTACGACATCTTGCTGATCGGTCATG
AGGGCCACGAGGAAGTCGTCGGTACTGCTGGGGAAGCTCCCGATCATGTGCAGCTGGTCGACG
GGGTGGACGCCGTCGACCAGGTGACCGTCCGTGACGAGGACAAAGTGGTTTGGCTGTCGCAG
ACCACCCTGTCCGTCGATGAGACCATGGAGATTGTCGGGCGGTTGCGTCGGCGTTTCCCCAAG
CTGCAGGATCCGCCCAGCGACGACATCTGCTATGCGACCCAGAATCGGCAGGTCGCGGTCAAG
GCGATGGCGCCCGAGTGCGAGCTGGTCATCGTGGTCGGCTCGCGCAATTCGTCGAATTCGGTT
CGGCTGGTCGAGGTGGCGCTGGGTGCCGGGGCGCGGGCCGCCCACCTGGTGGACTGGGCCG
ACGATATCGACTCGGCCTGGCTGGACGGCGTTACCACGGTCGGCGTTACGTCGGGGGCATCGG
TCCCCGAGGTGCTGGTGCGCGGTGTGCTGGAGCGGCTGGCCGAATGCGGCTACGACATCGTG
CAACCGGTGACAACGGCCAACGAGACGTTGGTGTTCGCATTGCCCCGGGAGCTCCGCTCACCT
CGCTGA

>Rv1216c - TB.seq 1359473:1360144 MW:24863
>emb|AL123456|MTBH37RV:c1360144-1359470, Rv1216c SEQ ID NO:43
ATGCACATTGGGCTGAAGATATTCATATGGGGCGTGTTAGGACTCGTCGTTTTCGGCGCGCTCC
TATTCGGGCCAGCCGGCACGTTCGACTATTGGCAGGCGTGGGTGTTCCTCGCCGCATTTGTGA
GCACCACGATTGGCCCCACAATCTATCTGGCTCGCAACGATCCCGCGGCCCTTCAACGTCGCAT
GCGCAGCGGTCCGCTCGCGGAGGGCCGAACGATTCAGAAGTTCATCGTCATCGGCGCTTTTCT
GGGGTTCTTCGCGATGATGGTGCTGAGCGCGTGCGACCATCGTTATGGTTGGTCGTCAGTGCC
AGCCGCGGTGTGCGTGATCGGCGACGTCCTAGTGATGACGGGCCTTGGCATCGCCATGCTGGT
GGTCATCCAGAACAGGTATGCCGCCTCGACGGTCAGGGTGGAGGCGGGCCAGATATTGGCCTC
CGACGGTCTCTACAAAATTGTCCGACACCCGATGTACGCCGGGAACGTGGTCATGATGACAGG
CATACCGCTGGCACTGGGCTCTTACTGGGCGATGTTCATCCTCGTCCCCGGCACACTGGTGTTG
GTGTTCCGCATCCTCGACGAGGAAAAACTACTGACGCAAGAACTCAGCGGGTACCGCGAATACC
GGCAACTGGTGCGCTACCGGTTGGTGCCCTACGTGTGGTAG

>Rv1223 htrA TB.seq 1365810:1367456 MW:56547
>emb|AL123456|MTBH37RV:1365810-1367459, htrA SEQ ID NO:44
GTGAGCCACTTGTCGCAGCGCATGGCGGGGTTGCTGCGAGTTCATGGCGAGTGGTCGCGATCC
GTGGATACTAGGGTGGACACGGACAACGCGATGCCTGCACGTTTTAGCGCCCAGATTCAGAAT
GAGGATGAGGTGACCTCCGACCAAGGCAACAACGGCGGCCCGAACGGCGGAGGCCGCCTGGC
GCCGCGCCCGGTTTTTCGGCCACCGGTCGACCCGGCGTCGCGTCAAGCGTTCGGGCGTCCGT
CCGGGGTCCAAGGGTCCTTTGTGGCCGAGCGTGTGCGCCCGCAGAAGTACCAGGACCAGTCT
GACTTCACACCGAACGATCAGCTTGCTGACCCGGTGCTTCAGGAGGCGTTCGGTCGTCCGTTC
GCGGGCGCCGAATCGCTGCAGCGCCATCCCATCGATGCCGGAGCGCTGGCAGCTGAGAAAGA
CGGTGCCGGCCCCGACGAGCCCGACGATCCGTGGCGCGACCCCGCGGCCGCGGCCGCGCTG
GGGACGCCAGCGCTAGCCGCGCCGGCACCGCACGGTGCGCTGGCCGGCAGCGGCAAGCTGG
GTGTGCGCGACGTGCTGTTTGGCGGCAAGGTGTCCTACTTGGCGCTGGGCATCTTGGTCGCTA
TCGCACTGGTGATCGGCGGCATCGGCGGTGTCATCGGCCGCAAGACCGCGGAAGTAGTCGAT
```

TABLE 3-continued

GCGTTCACCACGTCGAAGGTGACCCTGTCGACCACTGGCAATGCCCAGGAACCGGCCGGCCG
GTTCACCAAGGTGGCGGCCGCCGTGGCCGATTCGGTGGTGACCATTGAGTCGGTCAGCGACCA
GGAGGGCATGCAAGGTTCCGGCGTCATCGTCGATGGCCGCGGCTACATCGTCACCAACAATCA
CGTGATCTCTGAGGCGGCCAACAATCCCAGCCAGTTCAAGACGACCGTGGTGTTCAACGACGG
CAAGGAGGTGCCCGCCAATCTGGTGGGTCGTGACCCCAAGACCGACTTGGCCGTCCTCAAGGT
CGACAACGTCGACAATCTGACCGTGGCCCGGCTCGGTGATTCCAGCAAGGTACGGGTCGGTGA
CGAAGTCCTCGCGGTCGGCGCGCCCCTGGGGCTGCGCAGTACGGTGACCCAGGGCATTGTCA
GCGCGCTACACCGCCCCGTTCCGTTGTCGGGCGAGGGCTCTGACACCGACACCGTCATTGACG
CAATTCAGACCGACGCCTCGATCAACCACGGTAACTCCGGCGGTCCGCTAATCGACATGGATGC
CCAGGTGATTGGCATCAACACCGCCGGTAAGTCACTGTCGGATAGCGCCAGCGGGCTGGGCTT
TGCGATCCCGGTCAACGAGATGAAATTGGTGGCAAATTCTCTGATCAAAGACGGAAAGATCGTG
CATCCGACGTTGGGCATCAGCACCCGGTCAGTAAGCAACGCGATCGCGTCGGGCGCGCAGGT
GGCCAATGTAAAGGCGGGAAGTCCCGCGCAGAAGGGCGGGATCTTGGAGAACGATGTGATCGT
CAAGGTCGGTAACCGCGCGGTCGCCGACTCCGACGAGTTCGTCGTCGCCGTGCGCCAGTTGG
CTATCGGCCAGGACGCTCCGATAGAGGTGGTCCGCGAGGGTCGGCATGTGACGCTGACGGTG
AAACCGGACCCCGATAGCACCTAG

>Rv1224 - TB.seq 1367461:1367853 MW:14083
>emb|AL123456|MTBH37RV:1367461-1367856, Rv1224 SEQ ID NO:45
GTGTTCGCCAACATCGGTTGGTGGGAAATGCTCGTCCTCGTCATGGTCGGGCTGGTGGTGCTT
GGCCCGGAGCGGCTCCCGGGTGCCATCCGCTGGGCGGCAAGCGCTCTGCGGCAGGCGCGCG
ACTATCTCAGCGGTGTGACCAGCCAGCTACGTGAGGACATTGGACCCGAATTCGATGATCTGCG
GGGACATCTCGGTGAGCTGCAGAAGCTACGGGGAATGACTCCGCGGGCTGCGTTGACCAAGCA
CCTACTGGATGGCGATGATTCCCTGTTCACCGGAGACTTCGACCGACCGACGCCGAAGAAACC
GGATGCGGCGGGCTCGGCGGGGCCGGACGCTACTGAGCAGATCGGTGCGGGGCCCATCCCG
TTTGACAGCGATGCCACCTAG >Rv1229c mrp similar to MRP/NBP35 ATP-binding proteins TB.seq 1371778:1372947 MW:41064
>emb|AL123456|MTBH37RV:c1372947-1371775, mrp SEQ ID NO:46
ATGCCAAGCCGCCTACACTCGGCGGTGATGTCCGGAACTCGTGATGGCGACCTGAACGCGGCG
ATACGCACCGCGCTGGGCAAGGTAATCGACCCCGAATTGCGGCGCCCCATCACCGAACTGGGG
ATGGTCAAAAGCATCGACACCGGCCCGGATGGGAGCGTGCACGTCGAGATCTACCTGACCATC
GCCGGCTGCCCGAAGAAGTCCGAAATCACCGAGCGTGTCACCCGGGCGGTCGCCGACGTGCC
AGGCACTTCGGCGGTGCGGGTCAGCTTGGACGTGATGAGCGACGAGCAGCGCACCGAGCTGC
GTAAGCAGTTGCGTGGCGATACCCGCGAACCCGTCATCCCGTTCGCGCAACCCGATTCCTTGAC
CCGGGTGTATGCCGTGGCTTCCGGTAAGGGCGGAGTCGGAAAGTCCACCGTCACGGTCAACCT
GGCCGCCGCGATGGCCGTCCGCGGCCTGTCGATCGGGGTGCTGGACGCTGATATCCACGGCC
ACTCTATCCCCCGGATGATGGGCACCACCGACCGGCCTACCCAGGTTGAGTCGATGATCCTGC
CGCCGATCGCCCACCAGGTGAAGGTCATCTCGATAGCCCAGTTCACCCAGGGCAACACCCCGG
TGGTGTGGCGCGGGCCGATGCTGCACCGGGCGTTGCAGCAGTTTCTGGCCGACGTGTACTGG
GGGGATCTGGACGTGCTGCTGCTGGACTTGCCGCCCGGAACCGGCGACGTCGCCATCTCGGT
GGCTCAACTGATCCCCAACGCCGAACTCCTGGTGGTCACCACCCCGCAGCTGGCCGCCGCGGA
GGTGGCCGAACGGGCCGGCAGCATCGCGCTGCAAACCCGCCAACGCATCGTCGGCGTCGTGG
AGAACATGTCGGGGCTCACGCTGCCGGACGGCACCACGATGCAGGTGTTCGGCGAGGGCGGT
GGCCGGCTGGTCGCCGAGCGGTTGTCGCGTGCGGTCGGCGCCGACGTGCCGCTGCTGGGTCA
GATCCCGCTGGACCCCGCACTGGTGGCCGCCGGCGATTCGGGCGTACCGCTCGTGTTGAGCT
CGCCGGACTCGGCGATCGGCAAGGAACTGCATAGCATCGCCGACGGCTTGTCGACTCGACGAC
GCGGATTGGCGGGCATGTCGCTGGGGTTGGACCCGACACGACGCTAG >Rv1239c corA magnesium and cobalt transport protein TB.seq 1381943:1383040 MW:41470
>emb|AL123456|MTBH37RV:c1383040-1381940, corA SEQ ID NO:47
GTGTTCCCAGGGTTTGACGCATTGCCCGAAGTGCTGCGACCGGTCGCGCGACCCCAGCCGCCG
AACGCACACCCCGTTGCCCAGCCACCGGCCCAAGCCTTGGTCGACTGCGGTGTCTACGTCTGC
GGCCAGCGACTGCCCGGCAAGTACACCTACGCCGCCGCGCTGCGCGAGGTGCGCGAGATCGA
ACTGACCGGGCAGGAGGCGTTCGTCTGGATCGGGCTGCACGAGCCCGATGAAAACCAGATGCA
GGACGTAGCAGACGTTTTCGGGTTGCACCCGTTAGCCGTTGAGGACGCCGTGCACGCGCACCA
GCGACCCAAGTTGGAGCGCTACGACGAGACGCTGTTCCTCGTCCTCAAGACCGTCAACTACGT
CCCGCACGAATCGGTGGTACTGGCCCGCGAGATCGTCAAAACCGGCGAGATCATGATCTTCGT
CGGCAAGGATTTCGTGGTCACCGTCCGCCACGGCGAACACGGCGGGTTATCCGAGGTGCGTAA
GCGGATGGATGCCGACCCCGAACATTTGCGGTTGGGACCGTATGCGGTGATGCACGCGATCGC
CGACTACGTGGTCGACCACTACCTCGAGGTGACCAATCTCATGGAGACCGATATCGACAGCATC
GAGGAAGTAGCGTTCGCGCCGGGCCGCAAGCTCGACATCGAACCGATCTATCTGCTCAAGCGG
GAAGTGGTCGAGTTGCGCCGGTGCGTGAATCCGCTATCGACCGCATTCCAGCGCATGCAGACC
GAGAGCAAAGACCTCATTTCGAAAGAAGTGCGGCGCTACCTGCGCGACGTCGCCGACCACCAG
ACCGAGGCCGCCGACCAGATCGCCAGCTACGACGACATGCTCAACTCGCTGGTGCAGGCCGC
GCTCGCCCGGGTCGGCATGCAGCAAAACATGGACATGCGCAAGATATCCGCGTGGGCAGGTAT
CATCGCGGTCCCCACCATGATCGCGGGCATCTATGGCATGAACTTTCACTTCATGCCCGAGCTG
GACTCCAGGTGGGGTTACCCGACAGTGATCGGCGGGATGGTCCTTATCTGTCTGTTCCTCTACC
ACGTCTTCCGCAACAGAAACTGGCTCTAG >Rv1279 - TB.seq 1430060:1431643 MW:57332
>emb|AL123456|MTBH37RV:1430060-1431646, Rv1279 SEQ ID NO:48
ATGGACACTCAGAGCGACTACGTCGTGGTCGGTACCGGCTCAGCCGGGGCGGTTGTGGCCAG
CCGGCTTAGCACCGATCCGGCCACGACGGTGGTGGCCCTGGAGGCGGGGCCGCGTGACAAGA
ACAGATTCATCGGCGTCCCAGCGGCGTTTTCCAAGCTGTTCCGCAGCGAGATCGACTGGGATTA
CCTAACCGAACCGCAGCCGGAGCTCGACGGCCGCGAAATCTATTGGCCTCGTGGCAAGGTGCT
CGGTGGCTCGTCGTCCATGAACGCAATGATGTGGGTGCGTGGATTCGCATCAGACTACGATGA
GTGGGCCGCGCGAGCCGGTCCGCGGTGGTCGTACGCCGACGTGCTCGGCTACTTTCGCCGCA
TCGAGAACGTCACCGCTGCCTGGCACTTTGTCAGCGGTGACGACAGCGGAGTAACCGGTCCGT TABLE 3-continued

```
TGCATATTTCCCGGCAACGCAGCCCAAGATCGGTGACCGCAGCGTGGCTGGCAGCCGCACGTG
AGTGCGGATTTGCCGCTGCGCGGCCGAATTCCCCTCGACCGGAAGGCTTTTGCGAGACCGTCG
TCACCCAGCGCCGCGGTGCTCGATTCAGTACTGCCGACGCCTATCTGAAGCCCGCGATGCGCC
GTAAAAACCTCCGTGTGCTTACCGGCGCCACTGCTACCCGGGTGGTCATCGACGGCGACCGGG
CCGTCGGCGTGGAATACCAAAGCGACGGTCAAACCCGCATCGTCTACGCCCGCCGCGAGGTG
GTGCTCTGCGCTGGTGCCGTCAACAGCCCTCAGCTGCTGATGCTCTCCGGCATCGGCGACCGC
GACCACCTCGCCGAACACGACATCGACACCGTTTACCACGCGCCCGAGGTCGGGTGCAACCTG
CTCGATCATCTCGTCACGGTGCTGGGTTTCGACGTCGAAAAGGACAGCTTGTTTGCCGCCGAGA
AGCCCGGCCAGTTGATCAGCTACTTACTGCGACGCCGCGGCATGCTCACCTCCAACGTCGGCG
AGGCGTACGGATTTGTCCGCAGCCGACCCGAACTGAAGCTGCCCGATTTGGAGTTGATTTTTGC
CCCGGCGCCGTTTTACGACGAAGCGCTGGTTCCACCGGCTGGTCACGGTGTGGTATTCGGCCC
GATTCTGGTCGCGCCGCAAAGCCGTGGCCAGATCACGCTGCGGTCCGCCGATCCGCATGCCAA
GCCTGTCATCGAACCGCGTTACCTGTCCGATCTCGGTGGCGTAGACCGGGCCGCCATGATGGC
GGGCCTGCGGATATGCGCGCGGATCGCGCAGGCCCGCCCGCTCAGAGATCTCCTTGGGTCCA
TCGCGCGACCGCGCAACAGCACCGAGCTGGACGAGGCCACTCTCGAGTTGGCGCTGGCCACT
TGTTCGCACACCCTGTACCACCCGATGGGCACCTGCCGCATGGGCAGCGACGAGGCCAGCGT
GGTGGATCCGCAGCTGCGGGTCCGCGGTGTCGACGGACTCCGCGTCGCCGACGCGTCGGTGA
TGCCCAGCACGGTTCGTGGGCATACGCATGCGCCGTCGGTGCTGATCGGGGAGAAGGCCGCC
GACTTAATCCGCAGCTGA

>Rv1294 thrA homoserine dehydrogenase TB.seq 1449373:1450695 MW:45522
>emb|AL123456|MTBH37RV:1449373-1450698, thrA SEQ ID NO:49
GTGCCCGGTGACGAAAAGCCGGTCGGCGTAGCGGTACTCGGTTTGGGCAACGTCGGCAGCGA
GGTTGTCCGCATCATCGAGAACAGCGCCGAGGATCTCGCGGCTCGTGTCGGTGCCCCATTGGT
CCTGCGGGGCATCGGCGTGCGCCGCGTGACGACCGATCGCGGCGTGCCGATCGAATTGTTGA
CCGACGACATTGAAGAGCTCGTGGCCCGCGAGGATGTCGATATCGTGGTGGAAGTGATGGGGC
CGGTGGAACCGTCGCGCAAGGCGATCCTGGGCGCCCTTGAGCGCGGCAAGTCCGTCGTTACG
GCGAACAAGGCTTTACTCGCCACCTCCACCGGCGAATTGGCACAGGCCGCCGAAAGCGCCCAT
GTTGATCTGTATTTCGAGGCGGCCGTGGCGGGCGCCATTCCGGTCATCCGTCCGCTCACCCAG
TCGCTGGCCGGCGACACGGTGCTGCGAGTGGCCGGGATCGTCAACGGCACCACCAACTACATC
CTCTCGGCGATGGACAGCACCGGCGCTGACTATGCCAGCGCCCTGGCCGACGCAAGTGCGCT
GGGCTATGCGGAGGCTGATCCCACCGCAGACGTCGAAGGCTACGACGCCGCGGCCAAGGCAG
CGATCCTGGCATCCATTGCCTTCCACACCCGGGTGACCGCAGACGACGTGTATCGCGAAGGCA
TCACCAAGGTCACTCCGGCCGACTTCGGATCCGCGCACGCGCTGGGTTGCACCATCAAACTGC
TGTCGATCTGTGAGCGCATAACCACCGACGAAGGTTCGCAGCGGGTATCGGCCCGCGTCTATC
CGGCCCTGGTACCTCTGTCGCATCCGCTTGCCGCGGTCAACGGCGCGTTCAATGCCGTGGTGG
TCGAGGCCGAGGCCGCGGGCCGGCTGATGTTCTACGGCCAGGGCGCGGGCGGCGCGCCGAC
CGCCTCTGCGGTGACCGGTGACCTAGTGATGGCCGCCCGCAACCGGGTACTCGGCAGCCGCG
GCCCCCGTGAGTCTAAATACGCTCAACTTCCGGTGGCACCAATGGGTTTCATTGAAACGCGCTA
TTACGTCAGCATGAACGTCGCCGACAAGCCGGGCGTCTTGTCCGCGGTGGCGGCGGAATTCGC
CAAACGCGAGGTGAGCATCGCCGAGGTGCGCCAGGAGGGCGTTGTGGACGAAGGTGGTCGAC
GGGTGGGAGCCCGAATCGTGGTGGTCACGCACCTCGCCACTGACGCCGCACTCTCGGAAACC
GTTGATGCACTGGACGACTTGGATGTCGTGCAGGGTGTGTCCAGCGTGATACGACTGGAAGGA
ACCGGCTTATGA

>Rv1323 fadA4 acetyl-CoA C-acetyltransferase (aka thiL) TB.seq 1485860:1487026 MW:40049
>emb|AL123456|MTBH37RV:1485860-1487029, fadA4 SEQ ID NO:50
GTGATTGTTGCTGGCGCGCGTACACCCATCGGCAAGTTGATGGGCTCCCTGAAGGATTTCAGCG
CCAGCGAGCTGGGTGCCATCGCCATTAAGGGCGCCCTGGAGAAGGCCAACGTGCCGGCGTCC
TTGGTCGAGTACGTGATCATGGGCCAGGTGTTGACCGCGGGTGCCGGGCAAATGCCCGCACG
GCAGGCGGCAGTGGCGGCCGGCATCGGTTGGGATGTCCCTGCGCTGACGATCAACAAGATGT
GCCTGTCCGGCATCGACGCAATCGCGCTGGCTGATCAACTCATTCGGGCCAGAGAGTTCGACG
TGGTGGTGGCCGGCGGTCAGGAGTCGATGACGAAGGCGCCCCACCTGTTGATGAATAGCCGGT
CGGGTTACAAGTACGGCGACGTTACGGTTTTGGACCACATGGCCTACGACGGTCTGCACGACG
TGTTCACCGATCAGCCGATGGGCGCGCTCACCGAGCAACGCAACGACGTCGACATGTTCACCC
GCTCCGAACAGGACGAGTACGCGGCTGCGTCCCACCAAAAGGCGGCCGCGGCATGGAAGGAC
GGCGTATTCGCCGACGAGGTGATCCCGGTGAACATCCCGCAGCGCACGGGCGATCCACTGCA
GTTCACCGAGGACGAGGGGATCCGCGCCAACACCACCGCCGCCGCGCTGGCCGGTCTGAAGC
CGGCGTTCCGTGGCGACGGCACCATCACCGCCGGGTCGGCGTCACAGATCTCCGACGGTGCG
GCCGCGGTGGTGGTCATGAACCAGGAAAAGGCCCAGGAACTGGGGCTGACCTGGCTAGCCGA
GATCGGCGCCCACGGTGTGGTGGCCGGGCCGGATTCCACACTGCAATCGCAGCCGGCCAACG
CGATCAACAAGGCGCTGGATCGCGAGGGCATCTCGGTGGACCAGCTCGACGTGGTGGAGATCA
ACGAGGCGTTCGCTGCGGTGGCATTGGCCTCGATACGCGAACTCGGGCTGAACCCCCAGATCG
TCAACGTCAACGGTGGTGCGATTGCCGTCGGGCATCCCCTCGGCATGTCAGGGACGCGAATCA
CGCTACATGCGGCGCTGCAGTTGGCACGCCGGGGATCGGCGTCGGGGTTGCCGCATTGTGC
GGGGCTGGCGGGCAGGGCGACGCACTGATATTGCGGGCCGGATAG

>Rv1389 gmk putative guanylate kinase TB.seq 1564399:1565022 MW:22064
>emb|AL123456|MTBH37RV:1564399-1565025, gmk SEQ ID NO:51
GTGAGCGTCGGCGAGGGACCGGACACCAAGCCCACCGCGCGTGGCCAACCGGCGGCAGTGG
GACGTGTGGTGGTGCTGTCCGGTCCTTCCGCGGTCGGCAAATCCACGGTGGTTCGGTGTCTGC
GCGAGCGGATCCCGAATCTGCATTTCAGTGTCTCGGCCACGACGCGGGCGCCACGCCCGGGC
GAGGTCGACGGTGTCGACTACCACTTCATCGACCCCACCCGCTTTCAGCAGCTCATCGACCAG
GGTGAGTTGCTGGAATGGGCAGAAATCCACGGCGGCCTGCACCGGTCGGGCACTTTGGCCCA
GCCGGTGCGGGCGGCCGCGGCGACTGGTGTGCCGGTGCTTATCGAGGTTGACCTGGCCGGGG
CCAGGGCGATCAAGAAGACGATGCCCGAGGCTGTCACCGTGTTTCTGGCGCCACCTAGCTGGC
AGGATCTTCAGGCCAGACTGATTGGCCGCGGCACCGAAACAGCTGACGTTATCCAACGCCGCC
TGGACACCGCGCGGATCGAATTGGCAGCGCAGGGCGACTTTGACAAGGTCGTGGTGAACAGGC
GATTAGAGTCTGCGTGTGCGGAATTGGTATCCTTGCTGGTGGGAACGGCACCGGGCTCCCCGT
```

TABLE 3-continued

GA

>Rv1407 fmu similar to Fmu protein TB.seq 1583099:1584469 MW:48494
>emb|AL123456|MTBH37RV:1583099–1584472, fmu SEQ ID NO:52
ATGACCCCTAGATCGCGTGGGCCGCGCCGCCGGCCGCTGGACCCGGCGCGTCGTGCGGCCTT
CGAGACGCTGCGGGCGGTTAGTGCGCGCGACGCCTACGCGAACCTGGTGTTGCCCGCGCTGC
TGGCCCAACGCGGTATCGGCGGTCGCGACGCCGCGTTCGCCACCGAGCTGACATACGGCACC
TGCCGAGCCCGCGGCCTGCTCGACGCGGTCATCGGTGCGGCCGCCGAGCGTTCGCCGCAGGC
GATCGATCCGGTGCTGCTAGACCTGTTGCGGCTCGGCACCTACCAATTGCTGCGCACGCGGGT
CGACGCACACGCCGCAGTGTCGACCACCGTCGAGCAGGCCGGAATCGAATTCGATTCGGCGC
GAGCAGGTTTCGTCAACGGTGTACTACGAACGATCGCCGGCCGAGACGAGCGGTCCTGGGTTG
GCGAACTCGCTCCTGATGCGCAGAACGATCCGATCGGGCATGCCGCGTTCGTGCATGCGCATC
CCCGATGGATCGCCCAGGCCTTTGCTGACGCGTTGGGCGCGGCGGTCGGGGAGCTCGAGGCA
GTTTTGGCCAGCGACGACGAACGGCCAGCGGTGCACCTGGCGGCACGCCCCGGGGTGCTGAC
CGCCGGCGAACTGGCCCGCGCGGTGCGCGGAACCGTCGGTCGGTATTCGCCGTTTGCGGTGT
ATCTGCCGCGCGGTGACCCGGGGCGACTGGCGCCGGTGCGCGACGGCCAAGCGCTGGTCCA
GGACGAGGGCAGCCAGTTAGTCGCCCGAGCATTGACCCTGGCGCCAGTCGACGGCGATACCG
GACGGTGGCTGGACCTGTGTGCCGGACCGGGCGGCAAGACCGCGCTGTTGGCCGGGCTGGGT
TTGCAGTGCGCAGCCCGGGTGACCGCGGTGGAACCCTCGCCACACCGCGCGGACCTGGTAGC
ACAGAACACCCGCGGGCTGCCGGTTGAGCTCTTGCGTGTCGACGGGCGGCACACCGACCTCG
ACCCGGGTTTCGACCGGGTGCTGGTGGATGCGCCCTGCACCGGGCTGGGCGCGTTACGCCGT
CGGCCGGAGGCCCGTTGGCGTCGTCAGCCGGCGGACGTAGCGGCACTGGCCAAGCTACAACG
CGAGTTGTTGAGCGCCGCCATCGCGCTGACTCGGCCCGGCGGTGTCGTGCTCTATGCCACATG
CTCGCCGCACCTGGCCGAGACTGTGGGTGCTGTCGCCGACGCGCTACGCCGACATCCGGTTCA
CGCGCTCGATACCCGCCCACTGTTCGAGCCGGTGATCGCGGGGCTGGGGGAGGGGCCCCACG
TTCAGCTGTGGCCGCACCGGCACGGTACCGACGCCATGTTCGCCGCGGCGTTGCGCCGCCTG
ACGTGA >Rv1409 ribG riboflavin biosynthesis TB.seq 1585192:1586208 MW:35367
>emb|AL123456|MTBH37RV:1585192–1586211, ribG SEQ ID NO:53
ATGAACGTGGAGCAGGTCAAGAGCATCGACGAGGCTATGGGTCTCGCCATCGAGCACTCCTAC
CAGGTCAAAGGCACGACTTATCCAAAACCCCCAGTGGGGGCCGTCATTGTGGATCCCAACGGT
CGGATCGTCGGCGCCGGCGGCACCGAGCCGGCCGGTGGCGATCATGCCGAGGTGGTGGCGC
TGCGCCGGGCCGGCGGATTGGCTGCCGGCGCCATCGTGGTGGTCACCATGGAACCCTGTAAC
CACTACGGCAAGACTCCGCCATGCGTGAACGCTCTGATCGAAGCCAGGGTGGGGACGGTGGTC
TACGCCGTCGCCGACCCGAACGGGATCGCTGGGGGTGGCGCGGGCCGGCTGTCAGCAGCGG
GCCTACAGGTGCGGTCCGGGGTGTTGGCTGAACAGGTGGCGGCCGGACCGCTGCGGGAGTGG
CTCCACAAGCAACGCACCGGTCTGCCGCATGTCACCTGGAAGTACGCCACCAGCATCGACGGC
CGCAGCGCCGCCGCCGACGGCTCCAGCCAGTGGATCTCCAGCGAGGCCGCACGCCTGGATCT
GCATCGCCGCCGCGCCATCGCCGACGCGATCTTGGTCGGCACCGGCACCGTCCTCGCCGACG
ACCCGGCCCTGACCGCGCGGCTGGCCGACGGCTCGCTGGCGCCGCAGCAGCCGCTGCGCGT
GGTGGTGGGCAAGCGCGACATACCGCCGGAAGCACGGGTCCTCAACGACGAGGCACGCACCA
TGATGATCCGCACCCACGAACCTATGGAGGTGCTCAGGGCGTTGTCGGATCGCACCGACGTGC
TGCTGGAAGGAGGTCCCACCCTCGCCGGCGCCTTCCTACGAGCGGGTGCGATCAACCGGATCC
TGGCCTACGTCGCACCGATCCTGTTGGGCGGTCCGGTTACCGCGGTCGATGACGTCGGGGTGT
CCAACATCACCAACGCGTTGCGTTGGCAGTTCGACAGCGTCGAAAAGGTCGGACCGGATCTGTT
GCTGAGCTTGGTGGCTCGTTAG >Rv1440 secG TB.seq 1617715:1618065 MW:12140
>emb|AL123456|MTBH37RV:1617715–1618068, secG SEQ ID NO:54
GTGGCAGGCGTGACAGCCGCGGTCAGTGCACGCCTCAAAGCCGATGAGGCGCGACGGCCTGG
GTTCTACGCGGCAGGCAGCGGTCCGCTGCCGCAGGTTCGGGGGAGTACGCTACCCGTCATGG
AATTGGCCCTGCAGATCACGCTGATCGTCACGAGCGTGCTGGTGGTGTTGTTAGTACTGCTGCA
CCGGGCCAAGGGTGGCGGGCTATCGACACTGTTCGGCGGTGGTGTGCAGTCAAGCCTGTCCG
GCTCGACGGTGGTGGAGAAGAACCTGGACCGGTTGACGCTGTTCGTTACCGGCATCTGGCTGG
TGTCCATCATCGGCGTGGCGTTGCTCATCAAATACCGCTAG >Rv1484 inhA TB.seq 1674200:1675006 MW:28529
>emb|AL123456|MTBH37RV:1674200–1675009, inhA SEQ ID NO:55
ATGACAGGACTGCTGGACGGCAAACGGATTCTGGTTAGCGGAATCATCACCGACTCGTCGATCG
CGTTTCACATCGCACGGGTAGCCCAGGAGCAGGGCGCCCAGCTGGTGCTCACCGGGTTCGAC
CGGCTGCGGCTGATTCAGCGCATCACCGACCGGCTGCCGGCAAAGGCCCCGCTGCTCGAACT
CGACGTGCAAAACGAGGAGCACCTGGCCAGCTTGGCCGGCCGGGTGACCGAGGCGATCGGGG
CGGGCAACAAGCTCGACGGGGTGGTGCATTCGATTGGGTTCATGCCGCAGACCGGGATGGGC
ATCAACCCGTTCTTCGACGCGCCCTACGCGGATGTGTCCAAGGGCATCCACATCTCGGCGTATT
CGTATGCTTCGATGGCCAAGGCGCTGCTGCCGATCATGAACCCCGGAGGTTCCATCGTCGGCA
TGGACTTCGACCCGAGCCGGGCGATGCCGGCCTACAACTGGATGACGGTCGCCAAGAGCGCG
TTGGAGTCGGTCAACAGGTTCGTGGCGCGCGAGGCCGGCAAGTACGGTGTGCGTTCGAATCTC
GTTGCCGCAGGCCCTATCCGGACGCTGGCGATGAGTGCGATCGTCGGCGGTGCGCTCGGCGA
GGAGGCCGGCGCCCAGATCCAGCTGCTCGAGGAGGGCTGGGATCAGCGCGCTCCGATCGGCT
GGAACATGAAGGATGCGACGCCGGTCGCCAAGACGGTGTGCGCGCTGCTGTCTGACTGGCTG
CCGGCGACCACGGGTGACATCATCTACGCCGACGGCGGCGCGCACACCCAATTGCTCTAG >Rv1617 pykA pyruvate kinase TB.seq 1816187:1817602 MW:50668
>emb|AL123456|MTBH37RV:1816187–1817605, pykA SEQ ID NO:56
GTGACGAGACGCGGGAAAATCGTCTGCACTCTCGGGCCGGCCACCCAGCGGGACGACCTGGT
CAGAGCGCTGGTCGAGGCCGGAATGGACGTCGCCCGAATGAACTTCAGCCACGGCGACTACGA
CGATCACAAGGTCGCCTATGAGCGGGTCCGGGTAGCCTCCGACGCCACCGGGCGCGCGGTCG
GCGTGCTCGCCGACCTGCAGGGCCCGAAGATCAGGTTGGGACGCTTCGCCTCCGGGGCCACC TABLE 3-continued

```
CACTGGGCCGAAGGCGAAACCGTCCGGATCACCGTGGGCGCCTGCGAGGGCAGCCACGATCG
GGTGTCCACCACCTACAAGCGGCTAGCCCAGGACGCGGTGGCCGGTGACCGGGTGCTGGTCG
ACGACGGCAAAGTCGCATTGGTGGTCGACGCCGTCGAGGGCGACGACGTGGTCTGCACCGTC
GTCGAAGGCGGCCCGGTCAGCGACAACAAGGGCATCTCGTTGCCCGGAATGAACGTGACCGC
GCCGGCCCTGTCGGAGAAGGACATCGAGGATCTCACGTTCGCGCTGAACCTCGGCGTCGACAT
GGTGGCGCTTTCCTTCGTCCGCTCCCCGGCCGATGTCGAACTGGTCCACGAGGTGATGGATCG
GATCGGGCGACGGGTGCCGGTGATCGCCAAGCTGGAGAAGCCGGAAGCCATCGACAATCTCG
AAGCGATCGTGCTGGCGTTCGACGCCGTCATGGTCGCTCGGGGCGACCTAGGTGTTGAGCTGC
CGCTCGAAGAGGTCCCGCTGGTACAGAAGCGAGCCATCCAGATGGCCCGGGAGAACGCCAAG
CCGGTCATTGTGGCGACCCAGATGCTCGACTCGATGATCGAGAACTCGCGGCCGACCCGAGCT
GAGGCCTCCGACGTCGCCAACGCGGTGCTCGATGGCGCCGACGCGCTGATGCTGTCCGGGGA
AACCTCGGTAGGGAAGTACCCCCTTGCTGCGGTCCGGACAATGTCGCGCATCATCTGCGCGGT
CGAGGAGAACTCCACGGCCGCACCGCCGTTGACACACATTCCCCGGACCAAGCGTGGGGTCAT
CTCGTATGCGGCCCGTGACATCGGCGAACGACTCGACGCCAAGGCCTTGGTGGCCTTCACTCA
GTCCGGTGATACCGTGCGGCGACTGGCCCGCCTGCATACCCCGCTGCCGCTGCTGGCCTTCAC
CGCGTGGCCCGAGGTGCGCAGCCAACTGGCGATGACCTGGGGCACCGAGACGTTCATCGTGC
CGAAGATGCAGTCCACCGATGGCATGATCCGCCAGGTCGACAAATCGCTGCTCGAACTCGCCC
GCTACAAGCGTGGTGACTTGGTGGTCATCGTCGCGGGTGCGCCGCCAGGCACAGTGGGTTCGA
CCAACCTGATCCACGTGCACCGGATCGGGGAAGATGACGTCTAG

>Rv1630 rpsA 30S ribosomal protein S1 TB.seq 1833540:1834982 MW:53203
>emb|AL123456|MTBH37RV:1833540-1834985, rpsA SEQ ID NO:57
ATGCCGAGTCCCACCGTCACCTCGCCGCAAGTAGCCGTCAACGACATAGGCTCTAGCGAGGAC
TTTCTCGCCGCAATAGACAAAACGATCAAGTACTTCAACGATGGCGACATCGTCGAAGGCACCA
TCGTCAAAGTGGACCGGGACGAGGTGCTCCTCGACATCGGCTACAAGACCGAAGGCGTGATCC
CCGCCCGCGAACTGTCCATCAAGCACGACGTCGACCCCAACGAGGTCGTTTCCGTCGGTGACG
AGGTCGAAGCCCTGGTGCTCACCAAGGAGGACAAAGAGGGCCGGCTCATCCTCTCCAAGAAAC
GCGCGCAGTACGAGCGTGCCTGGGGCACCATCGAGGCGCTCAAGGAGAAGGACGAGGCCGTC
AAGGGCACGGTCATCGAGGTCGTCAAGGGTGGCCTGATCCTCGACATCGGGCTGCGCGGTTTC
CTGCCCGCCTCGCTGGTGGAGATGCGCCGGGTGCGCGACCTGCAGCCCTACATCGGCAAGGA
GATCGAGGCCAAGATCATCGAGCTGGACAAGAACCGCAACAACGTGGTGCTGTCCCGTCGCGC
CTGGCTGGAGCAGACCCAGTCCGAGGTGCGCAGCGAGTTCCTGAATAACTTGCAAAAAGGCAC
CATCCGAAAGGGTGTCGTGTCCTCGATCGTCAACTTCGGCGCGTTCGTCGATCTCGGCGGTGT
GGACGGTCTGGTGCATGTCTCCGAGCTATCGTGGAAGCACATCGACCACCCGTCCGAGGTGGT
CCAGGTTGGTGACGAGGTCACCGTCGAGGTGCTCGACGTCGACATGGACCGTGAGCGGGTTTC
GTTGTCACTCAAGGCGACTCAGGAAGACCCGTGGCGGCACTTCGCCCGCACTCACGCGATCGG
GCAGATCGTGCCGGGCAAGGTCACCAAGTTGGTTCCGTTCGGTGCATTCGTCCGCGTCGAGGA
GGGTATCGAGGGCCTGGTGCACATCTCCGAGCTGGCCGAGCGTCACGTCGAGGTGCCCGATC
AGGTGGTTGCCGTCGGCGACGACGCGATGGTCAAGGTCATCGACATCGACCTGGAGCGCCGTC
GGATCTCGTTGTCGCTCAAGCAAGCCAATGAGGACTACACCGAGGAGTTCGACCCGGCGAAGT
ACGGCATGGCCGACAGTTACGACGAGCAGGGCAACTACATCTTCCCCGAGGGCTTCGATGCCG
AAACCAACGAATGGCTTGAGGGATTCGAAAAGCAGCGCGCCGAATGGGAAGCTCGGTACGCCG
AGGCCGAGCGCCGGCACAAGATGCACACCGCGCAGATGGAGAAGTTCGCCGCCGCCGAGGCG
GCTGGACGCGGCGCGGACGATCAGTCGTCGGCCAGTAGCGCACCGTCGGAAAAGACCGCGGG
TGGATCACTGGCCAGCGACGCCCAGCTGGCGGCCCTGCGGGAAAAACTCGCCGGCAGCGCTT
GA

>Rv1631 - TB.seq 1835011:1836231 MW:44669
>emb|AL123456|MTBH37RV:1835011-1836234, Rv1631 SEQ ID NO:58
ATGCTGCGCATCGGGCTGACCGGCGGCATTGGCGCCGGGAAGTCGTTGCTGTCCACGACGTTC
TCGCAATGCGGCGGAATCGTTGTCGACGGCGATGTGTTGGCGCGTGAAGTGGTCCAGCCGGGC
ACCGAGGGGCTGGCCTCGCTGGTCGACGCGTTCGGTCGCGACATCCTGCTTGCAGACGGAGC
GCTGGACCGGCAGGCGTTGGCGGCCAAGGCGTTTCGAGATGACGAGTCGCGCGGTGTGCTCA
ACGGAATCGTGCACCCGCTGGTCGCCCGGCGCCGATCCGAGATCATCGCGGCGGTTTCGGGG
GACGCGGTTGTGGTCGAAGATATTCCACTGCTGGTGGAATCCGGGATGGCGCCATTGTTTCCGC
TGGTGGTGGTGGTGCACGCCGACGTCGAGCTACGGGTGCGACGGCTGGTCGAGCAACGCGGC
ATGGCCGAAGCCGACGCCCGGGCTAGGATCGCTGCGCAGGCCAGCGACCAGCAGCGTCGTGC
CGTCGCCGACGTCTGGCTGGACAACTCGGGCAGCCCAGAGGATTTGGTGCGGCGGGCCCGCG
ACGTCTGGAACACGCGCGTCCAGCCCTTCGCGCACAACCTGGCCCAACGTCAGATTGCGCGCG
CGCCGGCTAGGTTGGTGCCGGCGGATCCAAGCTGGCCGGATCAGGCGCGGCGCATCGTCAAC
CGGCTAAAGATCGCGTGCGGGCATAAGGCCTTGCGAGTTGACCACATTGGGTCAACCGCCGTG
TCGGGCTTCCCCGATTTTCTAGCCAAGGATGTCATCGACATCCAGGTCACCGTCGAATCACTTG
ACGTGGCCGACGAGCTGGCCGAGCCCTTGCTGGCCGCCGGCTACCCACGCCTCGAGCACATC
ACCCAGGACACCGAAAAGACCGACGCTCGCAGCACCGTCGGCCGCTACGACCACACCGACAGT
GCCGCTCTGTGGCACAAGCGCGTGCACGCCTCGGCGGATCCCGGTCGGCCGACCAACGTGCA
CCTGCGGGTGCACGGCTGGCCCAACCAACAGTTCGCCCTGCTGTTCGTCGACTGGCTGGCGGC
CAATCCCGGCGCGAGAGAAGACTATTTGACGGTCAAGTGTGACGCCGACAGGCGCGCCGACG
GTGAGCTCGCGCGCTACGTCACCGCCAAGGAGCCGTGGTTCCTGGATGCCTACCAGCGGGCAT
GGGAGTGGGCGGATGCGGTGCACTGGCGTCCCTGA

>Rv1706c - TB.seq 1932695:1933876 MW:39779
>emb|AL123456|MTBH37RV:c1933876-1932692, PPE SEQ ID NO:59
ATGACCCTCGATGTCCCGGTCAACCAGGGGCATGTCCCCCCGGGCAGCGTCGCCTGCTGCCTT
GTTGGGGTCACCGCCGTTGCTGACGGCATCGCCGGGCATTCCCTGTCCAACTTTGGGGCGTTA
CCTCCCGAGATCAATTCGGGTCGTATGTATAGCGGTCCGGGATCCGGGCCACTGATGGCTGCC
GCGGCGGCCTGGGACGGGCTGGCCGCAGAGTTGTCGTCGGCAGCGACTGGCTACGGTGCGG
CGATCTCGGAGCTGACAAACATGCGGTGGTGGTCGGGGCCGGCATCGGATTCGATGGTGGCC
GCCGTCCTGCCCTTTGTCGGCTGGCTGAGTACCACCGCGACGCTAGCCGAACAGGCCGCGATG
CAGGCTAGGGCGGCCGCAGCGGCCTTTGAAGCCGCCTTCGCCATGACGGTGCCCCCGCCGGC
```

TABLE 3-continued

```
GATCGCGGCCAACCGGACCTTGTTGATGACGCTCGTCGATACCAACTGGTTCGGGCAAAACAC
GCCGGCGATCGCCACCACCGAGTCCCAATACGCCGAGATGTGGGCCCAAGACGCCGCCGCGA
TGTACGGCTATGCCAGCGCCGCGGCACCCGCCACGGTTTTGACTCCGTTCGCACCACCGCCGC
AAACCACCAACGCGACCGGCCTCGTCGGCCACGCAACAGCGGTGGCCGCGCTGCGGGGGCAG
CACAGCTGGGCCGCGGCGATTCCATGGAGCGACATACAGAAATACTGGATGATGTTCCTGGGC
GCCCTCGCCACTGCCGAAGGGTTCATTTACGACAGCGGTGGGTTAACGCTGAATGCTCTGCAGT
TCGTCGGCGGGATGTTGTGGAGCACCGCATTGGCAGAAGCCGGTGCGGCCGAGGCAGCGGCC
GGCGCGGGTGGAGCCGCTGGATGGTCGGCGTGGTCGCAGCTGGGAGCTGGACCGGTGGCGG
CGAGCGCGACTCTGGCCGCCAAGATCGGACCGATGTCGGTGCCGCCGGGCTGGTCCGCACCG
CCCGCCACGCCCCAGGCGCAAACCGTCGCGCGATCGATTCCCGGTATTCGCAGCGCCGCCGA
GGCGGCTGAAACATCGGTCCTACTCCGGGGGGCACCGACTCCGGGCAGGAGTCGCGCCGCCC
ATATGGGACGCCGATATGGAAGACGACTCACCGTGATGGCTGACCGGCCGAACGTCGGATAG
```

```
>Rv1745c - similar to Q46822 ORF_O182 TB.seq 1971381:1971989 MW:22490
>emb|AL123456|MTBH37RV:c1971989–1971378, Rv1745c SEQ ID NO:60
ATGACCCGCAGCTACCGGCCAGCTCCACCGATCGAGCGGGTGGTTTTGCTCAACGACCGCGGC
GACGCGACAGGTGTGGCCGACAAGGCCACCGTGCACACCGGCGACACCCCTTTGCACCTCGC
GTTCTCCAGCTATGTGTTCGATCTGCACGATCAGCTGTTGATCACGCGGCGGGCCGCCACCAAG
AGGACGTGGCCGGCGGTATGGACCAACAGTTGCTGCGGGCACCCCCTGCCTGGCGAATCGCT
ACCCGGCGCCATACGCCGGCGGCTCGCTGCCGAACTCGGACTGACCCCAGATCGGGTCGATC
TGATCCTGCCGGGGTTCCGCTACCGGGCCGCTATGGCCGATGGCACCGTGGAAAACGAGATCT
GCCCCGTCTACCGAGTCCAGGTTGACCAACAGCCCCGGCCGAACTCGGACGAGGTCGACGCG
ATCCGCTGGTTGTCCTGGGAACAATTCGTGCGCGATGTTACCGCCGGCGTAATCGCCCCGGTAT
CCCCTTGGTGCCGCTCACAACTGGGCTACCTGACCAAACTTGGACCATGTCCGGCACAGTGGC
CCGTGGCCGACGACTGCCGGCTACCGAAAGCCGCACATGGTAATTAA
```

```
>Rv1800 - TB.seq 2039451:2041415 MW:67068
>emb|AL123456|MTBH37RV:2039451–2041418, PPE SEQ ID NO:61
ATGCTGCCGAATTTCGCGGTGCTGCCCCCCGAGGTCAATTCGGCGAGGGTGTTCGCCGGTGCG
GGGTCGGCGCCGATGTTAGCGGCAGCGGCCGCCTGGGATGATCTAGCCTCCGAGCTGCATTGT
GCTGCAATGTCATTCGGGTCGGTTACGTCGGGATTGGTGGTTGGGTGGTGGCAGGGATCGGCG
TCGGCGGCGATGGTGGACGCAGCCGCGTCGTACATCGGGTGGCTGAGCACGTCGGCTGCCCA
CGCCGAGGGCGCGGCCGGTCTGGCTCGGGCCGCGGTATCGGTGTTCGAGGAGGCGCTGGCC
GCGACGGTGCATCCGGCGATGGTTGCGGCAAATCGCGCCCAGGTGGCGTCGCTGGTAGCGTC
GAACTTGTTTGGGCAGAACGCGCCTGCGATCGCCGCGCTCGAATCCTTGTATGAGTGTATGTGG
GCCCAGGATGCAGCGGCCATGGCGGGTTATTACGTTGGGGCTTCGGCGGTGGCCACACAGTTG
GCATCGTGGCTGCAACGGCTACAGAGCATCCCCGGCGCCGCCAGTCTTGATGCCCGTCTGCCG
AGCTCGGCCGAGGCACCGATGGGAGTCGTCCGCGCGGTCAACAGCGCGATCGCCGCCAATGC
GGCTGCGGCACAAACCGTTGGCCTGGTCATGGGAGGCAGCGGCACGCCAATACCGTCGGCCA
GATATGTCGAGCTCGCGAACGCGCTGTACATGAGTGGCAGCGTCCCGGGTGTTATCGCGCAGG
CGCTCTTCACGCCCCAAGGGCTCTACCCGGTGGTCGTGATCAAGAACCTCACTTTCGATTCCTC
GGTGGCGCAGGGTGCCGTCATTCTCGAAAGTGCGATTCGGCAGCAAATTGCCGCCGGCAACAA
CGTCACCGTCTTCGGCTACTCGCAGAGCGCCACGATCTCGTCACTAGTGATGGCCAATCTTGCG
GCTTCGGCCGACCCGCCGTCTCCAGACGAGCTTTCCTTCACGCTGATCGGCAATCCCAACAACC
CCAATGGCGGGGTTGCCACCAGGTTCCCGGGGATCTCCTTTCCAAGCTTGGGCGTGACGGCCA
CCGGGGCCACTCCGCACAATCTGTACCCGACCAAGATCTACACCATCGAATACGACGGCGTCG
CCGACTTTCCGCGGTACCCGCTCAACTTTGTGTCGACCCTCAACGCCATTGCCGGCACCTACTA
CGTGCACTCCAACTACTTCATCCTGACGCCGGAACAAATTGACGCAGCGGTTCCGCTGACCAAT
ACGGTCGGTCCCACGATGACCCAGTACTACATCATTCGCACGGAGAACCTGCCGCTGCTAGAG
CCACTGCGATCGGTGCCGATCGTGGGGAACCCACTGGCGAACCTGGTTCAACCAAACTTGAAG
GTGATTGTTAACCTGGGCTACGGCGACCCGGCCTATGGTTATTCGACCTCGCCGCCCAATGTTG
CGACTCCGTTCGGGTTGTTCCCAGAGGTCAGCCCGGTCGTCATCGCCGACGCTCTCGTCGCCG
GGACCCAGCAGGGAATCGGCGATTTCGCCTACGACGTCAGCCACCTCGAACTGCCGTTGCCGG
CAGACGGGTCGACGATGCCAAGCACCGCACCGGGCTCGGGTACGCCGGTCCCCCCGCTCTCG
ATCGACAGCCTGATAGACGACCTGCAGGTGGCTAACCGCAACCTCGCCAACACGATTTCGAAG
GTGGCCGCGACGAGCTACGCGACGGTGCTCCCAACCGCCGACATCGCCAATGCGGCGTTGAC
GATCGTGCCGTCGTACAACATCCACCTTTTTTTGGAGGGCATCCAGCAAGCGCTCAAGGGCGAC
CCGATGGGACTCGTCAACGCGGTCGGATACCCACTCGCGGCCGACGTGGCACTGTTCACGGCC
GCAGGCGGTCTTCAGCTCTTGATCATCATCAGCGCGGGCCGAACGATTGCCAATGACATCTCGG
CCATTGTCCCCTGA
```

```
>Rv1844c gnd 6-phosphogluconate dehydrogenase (Gram -) TB.seq 2093732:2095186
MW:51548 >emb|AL123456|MTBH37RV:c2095186–2093729, gnd SEQ ID NO:62
ATGAGTTCGTCGGAATCGCCAGCCGGCATCGCGCAGATCGGCGTCACTGGCCTGGCCGTGATG
GGTTCCAACATCGCCCGAAACTTCGCCCGGCACGGCTACACCGTGGCAGTGCACAATCGGTCG
GTCGCCAAGACCGACGCGCTGCTTAAGGAGCACAGCTCAGACGGCAAGTTCGTGCGCAGTGAA
ACGATCCCCGAATTTCTTGCCGCACTGGAAAAACCGCGTCGGGTGCTGATCATGGTCAAGGCC
GGAGAGGCCACTGACGCTGACGCTGTCATCAACGAACTTGCTGACGCCATGGAACCCGGCGAC
ATCATCATCGACGGCGGCAATGCGTTGTACACCGACACCATGCGCCGCGAGAAAGCGATGCGT
GAGCGGGGCTTGCACTTCGTCGGGGCCGGGATCTCCGGCGGCGAAGAGGGCGCGTTGAACGG
GCCGTCGATCATGCCCGGCGGACCCGCCGAGTCATACCAATCGCTGGGTCCGCTGCTCGAGGA
GATCTCCGCGCATGTCGACGGCGTGCCGTGCTGCACCCACATTGGCCCGGACGGCTCCGGGC
ACTTCGTCAAGATGGTCCACAACGGCATCGAGTACTCCGACATGCAGCTCATCGGTGAGGCCTA
CCAGCTGATGCGCGACGGGCTAGGTCTGACCGCGCCGGCGATCGCCGATGTGTTCACCGAGT
GGAACAATGGCGATCTGGACAGCTACCTGGTCGAGATCACCGCCGAGGTGCTGCGGCAGACCG
ATGCCAAGACCGGCAAACCGCTCGTCGACGTCATCGTGGACCGGGCCGAGCAGAAAGGCACC
GGCCGTTGGACCGTCAAGTCCGCGCTGGACCTGGGTGTGCCGGTGACCGGCATCGCCGAAGC
GGTGTTTGCCCGCGCTCTCTCGGGATCCGTGGGCAACGCTCGGCCGCCAGCGGTCTGGCTTC
GGGCAAGCTCGGCGAGCAGCCCGCCGACCCCGCCACGTTCACCGAAGACGTCCGCCAGGCGT
```

TABLE 3-continued

TGTACGCCTCCAAGATCGTGGCCTACGCTCAGGGCTTCAACCAGATCCAGGCCGGCAGCGCCG
AATTCGGCTGGGACATCACGCCGGGCGACCTGGCCACCATCTGGCGTGGCGGCTGCATCATCC
GGGCGAAGTTCCTCAACCACATCAAGGAAGCCTTTGACGCCAGCCCGAACCTGGCCAGTCTGA
TTGTGGCCCCGTATTTCCGCGGCGCCGTCGAATCGGCGATCGACAGTTGGCGGCGTGTGGTGT
CGACGGCGGCCCAACTGGGTATCCCGACCCCGGGATTCTCGTCGGCCCTGTCGTATTACGACG
CGCTGCGCACCGCGCGGCTGCCCGCTGCACTCACCCAGGCCCAGCGCGACTTCTTCGGCGCA
CACACCTACGGCCGGATCGACGAACCAGGCAAGTTCCACACACTATGGAGTTCAGACCGCACC
GAAGTACCGGTGTAG

>Rv1900c lipJ TB.seq 2146246:2147631 MW:49685
>emb|AL123456|MTBH37RV:c2147631–2146243, lipJ SEQ ID NO:63
GTGGCGCAGGCTCCCCACATTCACAGGACCCGCTACGCAAAATGCGGCGACATGGATATCGCC
TACCAGGTGCTGGGTGACGGTCCGACGGATCTGCTGGTGTTGCCGGGGCCGTTCGTGCCGATC
GACTCGATCGACGACGAGCCATCGCTGTACCGTTTCCATCGCCGTCTTGCGTCATTCAGCAGGG
TGATCCGCCTCGACCATCGTGGGGTCGGCCTGTCGTCACGGCTCGCCGCGATAACCACGCTGG
GGCCGAAGTTCTGGGCCCAGGACGCGATCGCGGTGATGGACGCGGTCGGATGCGAGCAGGCG
ACAATTTTCGCGCCCAGTTTCCACGCCATGAACGGACTTGTTCTCGCCGCCGACTACCCCGAGC
GGGTGCGCAGCCTGATCGTCGTCAACGGCTCGGCGCGCCCACTATGGGCGCCCGACTACCCG
GTAGGCGCCCAGGTTCGTCGAGCTGACCCGTTCCTGACGGTGGCGCTGGAACCGGATGCCGTC
GAGCGGGGCTTCGACGTGCTGAGCATCGTGGCTCCTACCGTGGCCGGAGATGACGTGTTTCGA
GCCTGGTGGGATCTCGCCGGCAACCGTGCCGGACCGCCGAGCATTGCCCGTGCCGTTTCAAAG
GTCATAGCCGAGGCCGACGTACGAGATGTCTTGGGACACATCGAGGCTCCAACACTGATCTTGC
ACCGTGTCGGATCGACGTACATCCCGGTGGGACATGGTCGCTACCTCGCCGAGCACATCGCTG
GATCCCGCTTGGTCGAACTACCCGGCACCGATACCCTGTACTGGGTTGGCGACACCGGGCCGA
TGCTCGATGAAATCGAGGAATTCATCACCGGCGTGCGCGGCGGCGCTGACGCCGAGCGCATGC
TTGCCACCATCATGTTTACCGACATCGTCGGCTCGACCCAGCACGCCGCCGCGCTCGGCGACG
ACCGATGGCGCGACCTGTTGGACAACCACGACACCATCGTGTGCCACGAAATCCAGCGGTTCG
GCGGTCGCGAAGTGAACACGGCCGGTGACGGTTTCGTCGCGACGTTCACCAGTCCGAGTGCC
GCGATCGCGTGCGCGGACGACATCGTCGACGCGGTCGCCGCGCTGGGTATTGAGGTCCGGAT
CGGTATTCATGCGGGCGAGGTCGAGGTGCGCGATGCCTCGCACGGTACCGACGTCGCCGGCG
TGGCCGTGCATATCGGTGCGCGCGTCTGCGCGCTGGCCGGACCCAGTGAGGTGCTGGTGTCC
TCGACCGTGCGAGACATCGTCGCCGGATCACGGCACCGGTTCGCCGAGCGTGGTGAGCAGGA
ACTCAAGGGCGTACCGGGCAGATGGCGGCTATGCGTGCTCATGCGCGACGACGCCACCCGCA
CGCGCTAA >Rv1967 - TB.seq 2210599:2211624 MW:36516
>emb|AL123456|MTBH37RV:2210599–2211627, Rv1967 SEQ ID NO:64
ATGAGGGAGAACCTGGGGGGCGTCGTGGTGCGCCTCGGCGTCTTCCTGGCGGTATGCCTGCT
GACGGCGTTCCTGCTGATTGCCGTCTTCGGGGAGGTGCGCTTCGGCGACGGCAAGACCTACTA
CGCCGAGTTCGCCAACGTGTCCAATCTGCGAACGGGCAAGCTGGTGCGCATCGCCGGCGTCGA
GGTCGGCAAGGTCACCAGGATCTCCATCAACCCCGACGCGACGGTGCGGGTGCAGTTCACCGC
CGACAACTCGGTCACCCTCACGCGGGGCACCCGGGCGGTGATCCGCTACGACAACCTGTTCGG
TGACCGCTATTTGGCGCTGGAGGAAGGGGCCGGCGGACTCGCCGTTCTTCGTCCCGGTCACAC
GATTCCGTTGGCGCGCACCCAACCGGCGTTGGATCTGGATGCCCTGATCGGTGGATTCAAGCC
GCTGTTTCGTGCGCTGAACCCCGAGCAGGTCAACGCGCTGAGCGAACAGTTGCTGCACGCGTT
TGCCGGACAGGGGCCCACGATCGGGTCATTGCTGGCCCAGTCCGCGGCCGTGACCAACACCC
TGGCCGACCGTGATCGGCTGATCGGGCAGGTGATCACCAACCTCAACGTGGTGCTGGGCTCGC
TGGGCGCTCACACCGATCGGTTGGACCAGGCGGTGACGTCGCTATCAGCGTTGATTCACCGGC
TCGCGCAACGCAAGACCGACATCTCCAACGCCGTGGCCTACACCAACGCCGCCGCCGGCTCG
GTCGCCGATCTGCTGTCGCAGGCTCGCGCGCCGTTGGCGAAGGTGGTTCGCGAGACCGATCG
GGTGGCCGGCATCGCGGCCGCCGACCACGACTACCTCGACAATCTGCTCAACACGCTGCCGGA
CAAATACCAGGCGCTGGTCCGCCAGGGTATGTACGGCGACTTCTTCGCCTTCTACCTGTGCGAC
GTCGTGCTCAAGGTCAACGGCAAGGGCGGCCAGCCGGTGTACATCAAGCTGGCCGGTCAGGA
CAGCGGGCGGTGCGCGCCGAAATGA >Rv1975 - TB.seq 2218050:2218712 MW:23650
>emb|AL123456|MTBH37RV:2218050–2218715, Rv1975 SEQ ID NO:65
ATGTCGCGTCGAGCATCGGCCACGTGTGCCTTGTCCGCGACCACCGCCGTCGCCATAATGGCT
GCTCCCGCCGCACGGGCCGACGACAAGCGGCTCAACGACGGCGTGGTCGCCAACGTCTACAC
CGTTCAACGTCAGGCCGGCTGCACCAACGACGTCACGATCAACCCGCAACTACAATTGGCCGC
CCAATGGCACACCCTCGATCTGCTGAACAACCGGCACCTCAACGACGACACCGGTTCTGACGG
ATCCACACCGCAAGACCGCGCGCATGCCGCCGGCTTCCGCGGGAAAGTCGCTGAAACCGTGG
CGATCAATCCCGCCGTAGCGATCAGCGGCATCGAGTTGATAAACCAGTGGTACTACAACCCCGC
GTTTTTCGCGATCATGTCCGACTGCGCCAACACCCAGATCGGGGTGTGGTCAGAAAACAGCCC
GGATCGCACCGTCGTGGTGGCCGTTTACGGACAGCCCGATCGACCTTCCGCGATGCCGCCCAG
GGGAGCGGTAACCGGACCGCCGTCCCCGGTGGCCGCGCAAGAGAACGTTCCTATCGACCCCA
GCCCCGACTACGACGCCAGCGACGAGATCGAATACGGCATCAACTGGCTGCCATGGATCCTGC
GCGGCGTGTACCCGCCGCCCGCAATGCCGCCGCAGTAG >Rv1981c nrdF ribonucleotide reductase small subunit TB.seq 2224221:2225186 MW:36591
>emb|AL123456|MTBH37RV:c2225186–2224218, nrdF SEQ ID NO:66
ATGACCGGCAAGCTCGTTGAGCGGGTGCACGCAATCAATTGGAACCGGTTGCTCGATGCTAAA
GATTTGCAGGTCTGGGAACGTTTGACCGGTAACTTTTGGTTGCCGGAAAAGATTCCGCTCTCCA
ACGACCTGGCATCTTGGCAAACGTTGAGTTCCACCGAGCAGCAGACGACGATCCGGGTGTTCA
CCGGCTTGACCCTGCTCGACACCGCGCAGGCGACGGTGGGAGCAGTGGCCATGATCGACGAC
GCGGTCACCCCCCACGAAGAGGCGGTCCTGACCAACATGGCGTTCATGGAGTCAGTGCACGCC
AAGAGCTACAGCTCGATCTTCTCGACCCTGTGCTCGACCAAGCAGATCGACGATGCCTTCGACT
GGTCGGAACAGAACCCTTACCTGCAGCGAAAAGCGCAGATCATCGTCGACTACTACCGCGGTG
ACGACGCGCTCAAGCGCAAAGCATCGTCGGTAATGCTGGAGTCCTTCCTGTTCTACTCCGGCTT TABLE 3-continued

```
CTACCTGCCCATGTACTGGTCGTCGCGGGGTAAGCTCACCAACACCGCCGATCTGATCCGGCT
GATCATCCGAGATGAAGCCGTCCACGGCTACTACATCGGCTACAAATGTCAACGAGGTTTGGCC
GACCTGACCGACGCCGAGCGGGCCGACCACCGCGAATACACCTGCGAGCTGCTGCACACGCT
CTACGCGAACGAGATCGACTATGCGCACGACTTGTACGACGAGTTGGGCTGGACCGACGACGT
TTTGCCCTACATGCGTTACAACGCCAACAAGGCGCTAGCCAACCTGGGATACCAGCCTGCATTC
GATCGTGACACCTGCCAGGTGAACCCGGCCGTGCGCGCAGCTCTCGACCCCGGTGCAGGGGA
GAACCACGACTTTTTCTCCGGCTCCGGAAGCTCATACGTAATGGGCACCCACCAACCCACCACC
GACACCGACTGGGACTTCTAA
```

```
>Rv2092c helY helicase, Ski2 subfamily TB.seq 2349335:2352052 MW:99576
>emb|AL123456|MTBH37RV:c2352052—2349332, helY SEQ ID NO:67
GTGACTGAGCTGGCCGAGCTGGACCGGTTCACCGCGGAACTACCGTTCTCGCTCGACGACTTT
CAGCAGCGGGCTTGCAGCGCGCTGGAACGCGGCCACGGTGTGCTGGTGTGCGCGCCGACCG
GCGCTGGCAAGACGGTGGTCGGCGAGTTCGCCGTGCACCTGGCGCTGGCGGCCGGCAGTAAA
TGTTTCTACACCACGCCGCTGAAAGCCCTGAGCAACCAAAAGCACACCGATCTCACAGCACGCT
ACGGCCGTGACCAGATCGGGCTGCTGACCGGTGACCTGTCGGTCAACGGCAACGCGCCGGTG
GTGGTGATGACCACCGAAGTGCTGCGCAACATGCTCTACGCGGATTCGCCTGCGCTGCAGGGG
CTTTCCTATGTGGTGATGGATGAGGTGCATTTCCTCGCCGACCGGATGCGGGGTCCGGTGTGG
GAGGAGGTGATCCTGCAACTGCCCGACGACGTGCGGGTGGTCAGCCTGTCGGCGACGGTGAG
CAACGCCGAGGAGTTCGGCGGTTGGATCCAGACGGTGCGGGGCGACACCACGGTGGTGGTCG
ACGAGCATCGGCCGGTGCCGTTGTGGCAACACGTCTTGGTGGGCAAGCGCATGTTCGACCTGT
TCGATTACCGGATCGGCGAAGCCGAAGGGCAGCCCCAAGTCAACCGCGAGTTGCTGCGCCACA
TCGCGCATCGCCGTGAGGCCGACCGGATGGCCGATTGGCAGCCTCGGCGCCGAGGCTCGGGC
CGGCCCGGCTTCTACCGGCCACCCGGCCGACCCGAGGTGATCGCCAAACTCGACGCTGAAGG
GCTGTTGCCGGCGATCACCTTCGTGTTCTCCCGGGCCGGTTGTGACGCCGCGGTCACCCAATG
CCTGCGGTCACCGCTGCGGTTGACCAGCGAAGAGGAGCGCGCACGGATCGCCGAGGTGATCG
ACCACCGCTGCGGTGACCTGGCCGACTCCGACCTGGCGGTACTCGGCTACTACGAATGGCGG
GAAGGGTTACTGCGCGGTCTGGCCGCCCACCACGCGGGCATGTTGCCGGCCTTCCGGCACAC
GGTGGAGGAGCTGTTCACCGCCGGTTTGGTCAAGGCTGTATTCGCCACCGAGACTCTGGCGCT
CGGTATCAACATGCCGGCCCGCACGGTGGTGCTGGAGCGGCTGGTGAAGTTCAACGGTGAGCA
GCACATGCCGCTGACGCCGGGGGAGTACACCCAACTGACCGGTCGCGCCGGCCGGCGCGGTA
TCGACGTCGAGGGTCACGCGGTGGTGATCTGGCACCCGGAAATTGAACCGTCCGAGGTGGCG
GGCCTGGCCTCCACCCGCACCTTTCCGCTGCGCAGCTCGTTTGCCCCGTCGTACAACATGACG
ATCAACCTGGTGCACCGGATGGGTCCGCAACAGGCGCACCGACTGCTCGAGCAGTCGTTCGCC
CAATATCAGGCCGACCGATCCGTGGTCGGACTGGTCCGCGGAATTGAGCGGGGCAACAGGATA
CTCGGCGAGATCGCAGCCGAACTGGGCGGATCTGATGCGCCCATCCTCGAATACGCTCGATTG
CGCGCGCGGGTGTCCGAGCTGGAACGTGCGCAGGCCCGCGCGTCGCGGTTACAGCGACGGC
AGGCGGCCACCGATGCGCTGGCCGCGCTGCGCCGCGGTGACATCATCACCATCACCCACGGC
CGCCGCGGTGGTCTGGCCGTCGTCCTGGAATCAGCCCGCGACCGCGACGACCCGCGTCCGCT
GGTGCTAACCGAACACCGATGGGCGGGACGGATCTCCTCGGCCGACTACTCGGGCACGACGC
CGGTGGGGTCGATGACGCTGCCCAAGCGGGTGGAGCACCGCCAGCCGCGGGTCCGGCGTGA
CCTGGCCTCGGCGCTGCGATCGGCAGCCGCGGGTCTGGTTATTCCAGCCGCCCGGCGCGTCA
GCGAGGCCGGCGGGTTTCACGATCCGGAGCTGGAGTCGTCGCGCGAACAATTGCGCCGTCAT
CCGGTGCATACCTCGCCCGGGCTCGAGGACCAGATCCGCCAGGCCGAGCGTTACTTACGCATC
GAACGCGACAACGCGCAATTAGAGAGGAAGGTCGCCGCCGCCACCAACTCGTTGGCCCGCAC
GTTCGACCGATTCGTCGGGCTGCTCACCGAACGGGAGTTCATCGATGGCCCGGCCACTGATCC
CGTGGTCACCGACGACGGCCGGCTGCTGGCGCGGATTTACAGCGAGAGCGACCTGTTGGTGG
CCGAGTGCCTACGTACAGGTGCGTGGGAGGGTTTAAAGCCGGCCGAATTGGCGGGGGTGGTG
TCGGCGGTGGTCTACGAGACGCGCGGTGGTGACGGCCAGGGCGCCCCGTTCGGAGCCGATGT
GCCCACACCGCGGTTACGGCAGGCTCTGACTCAGACATCAAGGCTGTCCACGACATTGCGCGC
CGACGAGCAGGCACACCGCATCACCCCGAGTCGCGAACCCGACGATGGCTTTGTCAGAGTCAT
CTACCGCTGGTCGCGAACCGGTGATCTAGCGGCGGCATTGGCCGCTGCCGACGTGAACGGCA
GCGGATCACCGTTATTGGCAGGGGATTTCGTGCGTTGGTGCCGTCAGGTGCTCGATCTGCTGG
ACCAAGTTCGTAACGCTGCGCCCAACCCCGAACTGCGGGCTACCGCAAAGCGCGCTATCGGTG
ACATTCGGCGCGGCGTCGTCGCGGTTGACGCCGGGTAG
```

```
>Rv2101 helZ helicase, Snf2/Rad54 family TB.seq 2360238:2363276 MW:111632
>emb|AL123456|MTBH37RV:2360238—2363279, helZ SEQ ID NO:68
ATGCTGGTTTTGCACGGCTTCTGGTCCAACTCCGGCGGGATGCGGCTGTGGGCGGAGGACTCC
GATCTGCTGGTGAAGAGCCCGAGTCAGGCGCTGCGCTCCGCGCGGCCACACCCGTTCGCGGC
GCCCGCTGACCTGATCGCCGGCATACATCCGGGCAAACCCGCAACCGCCGTTTTGCTGTTGCC
GTCGTTGCGATCGGCGCCGCTGGACTCGCCGGAGCTGATCCGGCTCGCCCCGCGCCCGGCCG
CGCGAACCGATCCGATGCTGTTGGCGTGGACGGTACCGGTGGTGGACCTGGACCCCACCGCG
GCGTTGGCCGCCTTCGACCAGCCCGCCCCCGACGTCCGCTACGGCGCGTCCGTCGACTACCT
GGCCGAGCTGGCCGTTTTCGCGCGCGAGTTGGTCGAGCGTGGTCGCGTGCTGCCCCAGCTGC
GCCGCGACACCCACGGCGCGGCCGCCTGCTGGCGTCCGGTGTTGCAGGGACGCGACGTGGTC
GCGATGACCTCGCTGGTCTCGGCGATGCCGCCGGTCTGCCGCGCCGAAGTTGGTGGGCACGA
CCCGCACGAACTGGCAACCTCGGCTCTGGACGCGATGGTCGACGCCGCCGTGCGCGCGGCGC
TGTCACCGATGGACCTGCTGCCCCCGCGACGGGGTCGCTCCAAACGGCATCGGGCCGTGGAG
GCTTGGCTGACCGCGTTGACCTGCCCGGACGGCCGGTTCGACGCGGAGCCCGACGAACTCGA
CGCGCTGGCCGAGGCGTTGCGGCCATGGGACGACGTCGGTATCGGCACCGTCGGCCCGGCGC
GGGCGACGTTTCGGCTGTCCGAAGTCGAGACCGAAAACGAGGAGACGCCCGCGGGCTCGTTG
TGGAGGCTGGAGTTCTTATTGCAGTCGACGCAGGACCCCAGCCTGCTGGTCCCCGCCGAGCAG
GCATGGAACGACGACGGCAGCCTGCGCCGCTGGCTGGACCGGCCGCAGGAGCTGCTGCTGAC
CGAACTGGGCCGGGCCTCTCGGATTTTCCCCGAGCTCGTCCCGGCGCTGCGCACCGCGTGCC
CGTCCGGGCTTGAGCTCGACGCCGACGGCGCCTACCGATTCCTGTCGGGTACGGCCGCGGTG
CTCGACGAGGCTGGGTTTGGCGTGCTGCTGCCGTCCTGGTGGGACCGCCGCCGCAAGCTGGG
CTTGGTCCTGTCCGCATATACCCCGGTCGACGGCGTGGTGGGCAAGGCCAGCAAGTTCGGCCG
CGAGCAGCTCGTCGAGTTCCGCTGGGAGCTGGCCGTGGGCGACGATCCGCTCAGCGAGGAGG
```

TABLE 3-continued

AGATCGCGGCGCTGACCGAAACCAAGTCCCCGCTGATCCGGCTGCGTGGCCAGTGGGTCGCG
CTCGATACCGAACAGATGCGCCCGCGGGCTGGAGTTTTTGGAGCGTAAGCCAACCGGCCGCAAG
ACCACCGCCGAGATCCTCGCGCTGGCCGCCAGCCACCCCGACGACGTGGACACCCCGCTCGA
GGTCACCGCCGTACGCGCCGACGGCTGGCTCGGGGACCTGCTCGCCGGGGCCGCCGCGGCG
TCGCTGCAGCCGTTGGACCCGCCCGACGGATTCACCGCGACGCTGCGTCCCTACCAGCAGCGC
GGTCTGGCGTGGCTGGCGTTTTTGTCCTCGCTCGGTTTGGGCAGCTGCCTGGCCGACGACATG
GGCCTGGGCAAGACGGTGCAGCTATTGGCCCTGGAAACCTTGGAATCCGTTCAGCGCCACCAG
GATCGCGGCGTCGGACCCACACTGCTACTGTGCCCGATGTCGTTGGTGGGCAACTGGCCGCAG
GAAGCGGCCAGGTTTGCACCCAACCTGCGGGTGTACGCCCACCACGGGGGCGCCCGGCTGCA
CGGCGAGGCGTTGCGCGACCACCTCGAGCGCACCGACCTGGTCGTGAGCACCTATACCACCG
CCACCCGCGACATCGACGAGCTGGCGGAATACGAATGGAACCGGGTGGTGCTGGACGAGGCC
CAGGCGGTGAAGAACAGCCTGTCCCGGGCGGCCAAGGCGGTGCGACGGCTACGCGCGGCGC
ACCGGGTCGCGCTGACCGGGACACCGATGGAGAACCGGCTCGCCGAGCTGTGGTCGATCATG
GACTTCCTCAACCCGGGCCTGCTCGGATCCTCCGAACGCTTCCGCACCCGCTACGCGATCCCG
ATCGAGCGGCACGGGCACACCGAACCGGCCGAACGGCTGCGCGCATCGACGCGGCCCTACAT
CCTGCGCCGGCTCAAGACCGACCCGGCGATCATCGACGATCTGCCGGAGAAGATCGAGATCAA
GCAGTACTGCCAACTCACCACCGAGCAGGCGTCGCTGTATCAGGCCGTCGTCGCCGACATGAT
GGAAAAGATCGAAAACACCGAAGGGATCGAGCGGCGCGGCAACGTGCTGGCCGCGATGGCCA
AGCTCAAACAGGTGTGCAACCACCCCGCCCAGCTGCTGCACGATCGCTCCCCGGTCGGTCGGC
GGTCCGGGAAGGTGATCCGGCTCGAGGAGATCCTGGAAGAGATCCTGGCCGAGGGCGACCGG
GTGCTGTGTTTTACCCAGTTCACCGAGTTCGCCGAGCTGCTGGTGCCGCACCTGGCCGCACGC
TTCGGCCGTGCCGCCCGAGACATTGCCTACCTGCACGGTGGCACCCCGAGGAAGCGGCGTGA
CGAGATGGTGGCCCGGTTCCAGTCCGGTGACGGCCCGCCCATTTTTCTGCTGTCGTTGAAGGC
GGGCGGTACCGGGCTGAACCTCACCGCCGCCAATCATGTTGTGCACCTGGACCGCTGGTGGAA
CCCGGCGGTCGAGAACCAGGCGACGGACCGGGCGTTTCGGATCGGGCAGCGGCGCACGGTG
CAGGTCCGCAAGTTCATCTGCACCGGCACCCTCGAGGAGAAGATCGACGAAATGATCGAGGAG
AAAAAGGCGCTGGCCGACTTGGTGGTCACCGACGGCGAAGGCTGGCTGACCGAACTGTCCACC
CGCGATCTGCGCGAGGTGTTCGCGCTGTCCGAAGGCGCCGTCGGTGAGTAG

>Rv2110c prcB proteasome [beta]-type subunit 2 TB.seq 2369727:2370599 MW:30274
>emb|AL123456|MTBH37RV:c2370599–2369724, prcB SEQ ID NO:69
GTGACCTGGCCGTTGCCCGATCGCCTGTCCATTAATTCACTCTCTGGAACACCCGCTGTAGACC
TATCTTCTTTCACTGACTTCCTGCGCCGCCAGGCGCCGGAGTTGCTGCCGGCAAGCATCAGCG
GCGGTGCGCCACTCGCAGGCGGCGATGCGCAACTGCCGCACGGCACCACCATTGTCGCGCTG
AAATACCCCGGCGGTGTTGTCATGGCGGGTGACCGGCGTTCGACGCAGGGCAACATGATTTCT
GGGCGTGATGTGCGCAAGGTGTATATCACCGATGACTACACCGCTACCGGCATCGCTGGCACG
GCTGCGGTCGCGGTTGAGTTTGCCCGGCTGTATGCCGTGGAACTTGAGCACTACGAGAAGCTC
GAGGGTGTGCCGCTGACGTTTGCCGGCAAAATCAACCGGCTGGCGATTATGGTGCGTGGCAAT
CTGGCGGCCGCGATGCAGGGTCTGCTGGCGTTGCCGTTGCTGGCGGGCTACGACATTCATGCG
TCTGACCCGCAGAGCGCGGGTCGTATCGTTTCGTTCGACGCCGCCGGCGGTTGGAACATCGAG
GAAGAGGGCTATCAGGCGGTGGGCTCGGGTTCGCTGTTCGCGAAGTCGTCGATGAAGAAGTTG
TATTCGCAGGTTACCGACGGTGATTCGGGGCTGCGGGTGGCGGTCGAGGCGCTCTACGACGCC
GCCGACGACGACTCCGCCACCGGCGGTCCGGACCTGGTGCGGGGCATCTTTCCGACGGCGGT
GATCATCGACGCCGACGGGGCGGTTGACGTGCCGGAGAGCCGGATTGCCGAATTGGCCCGCG
CGATCATCGAAAGCCGTTCGGGTGCGGATACTTTCGGCTCCGATGGCGGTGAGAAGTGA >Rv2118c - = B2126_C1_165 (83.6%) TB.seq 2377471:2378310 MW:30091
>emb|AL123456|MTBH37RV:c2378310–2377468, Rv2118c SEQ ID NO:70
GTGTCAGCAACCGGCCCATTCAGCATCGGCGAACGTGTTCAGCTCACCGACGCTAAGGGGCGC
CGCTACACCATGTCGCTGACTCCCGGTGCCGAATTCCACACTCATCGTGGCTCGATCGCCCACG
ACGCGGTGATCGGGTTGGAGCAAGGCAGCGTGGTCAAATCCAGCAACGGCGCCCTGTTCCTGG
TGCTGCGCCCGCTGCTGGTCGACTACGTCATGTCGATGCCGCGCGGCCCGCAGGTGATCTATC
CCAAAGATGCGGCCCAGATCGTGCATGAGGGCGACATATTTCCCGGCGCGCGGGTGCTGGAG
GCAGGAGCCGGATCCGGTGCTCTGACCTTGTCTTTGCTGCGGGCGGTTGGGCCGGCCGGACA
GGTGATCTCCTACGAACAGCGCGCCGATCATGCCGAACACGCCCGGCGCAATGTGAGCGGCTG
CTACGGCCAGCCGCCGGACAACTGGCGACTGGTCGTCAGCGACCTCGCCGACTCCGAACTGC
CCGACGGATCCGTTGATCGGGCCGTGCTCGACATGCTGGCGCCGTGGGAGGTGCTCGACGCG
GTATCGCGGCTGCTGGTCGCCGGCGGAGTGCTGATGGTCTACGTGGCCACCGTCACTCAGCTG
TCGAGGATCGTGGAGGCACTGCGGGCCAAGCAGTGCTGGACCGAACCGAGAGCCTGGGAGAC
GCTGCAGCGGGGCTGGAACGTCGTAGGGTTGGCGGTTCGGCCGCAGCATTCGATGCGCGGGC
ATACCGCGTTCCTGGTAGCAACGCGCCGGTTGGCGCCGGGGGCTGTGGCTCCGGCGCCGCTA
GGTCGTAAGCGCGAGGGACGCGACGGGTAG >Rv2144c - TB.seq 2404166:2404519 MW:12028
>emb|AL123456|MTBH37RV:c2404519–2404163, Rv2144c SEQ ID NO:71
ATGCTGATCATTGCGCTGGTCTTGGCCCTGATTGGGCTCCTGGCCTTGGTGTTCGCGGTGGTCA
CCAGCAACCAGCTAGTGGCCTGGGTATGCATCGGGGCCAGCGTGCTGGGTGTGGCGTTGCTGA
TCGTCGATGCGTTGCGAGAACGCCAGCAAGGTGGCGCGGACGAAGCTGATGGGGCTGGGGAA
ACGGGTGTCGCGGAGGAAGCCGACGTCGACTACCCGGAGGAAGCCCCCGAGGAGAGCCAAGC
CGTCGACGCCGGTGTCATCGGCAGTGAGGAGCCATCGGAGGAGGCCAGCGAAGCGACCGAGG
AGTCGGCGGTATCGGCGGACCGAAGCGACGACAGCGCCAAGTAG >Rv2146c - TB.seq 2405667:2405954 MW:10805
>emb|AL123456|MTBH37RV:c2405954–2405664, Rv2146c SEQ ID NO:72
TTGGTGGTGTTTTTTCAGATCCTTGGGTTCGCGCTGTTCATCTTCTGGCTGCTGCTGATCGCTCG
GGTCGTCGTTGAGTTCATCCGCTCGTTCAGCCGTGACTGGCGTCCCACCGGTGTCACCGTGGT
GATCTTGGAGATCATCATGTCGATCACTGATCCGCCGGTGAAGGTGCTGCGCCGGCTGATCCC
GCAACTCACGATCGGCGCGGTCCGGTTCGACCTGTCGATCATGGTGCTGCTGCTGGTTGCGTT
CATCGGTATGCAACTGGCGTTTGGTGCTGCGGCCTGA TABLE 3-continued

```
>Rv2147c - TB.seq 2406119:2406841 MW:27630
>emb|AL123456|MTBH37RV:c2406841-2406116, Rv2147c SEQ ID NO:73
GTGAATAGTCACTGTAGTCACACCTTCATCACAGACAACAGATCTCCCAGGGCTAGAAGGGGTC
ACGCAATGAGCACACTGCACAAGGTCAAGGCCTACTTCGGTATGGCTCCCATGGAGGATTACGA
CGACGAGTACTACGACGACCGCGCTCCCTCGCGCGGGTATGCGCGGCCCCGATTCGACGACG
ACTACGGCCGCTACGATGGGCGCGACTACGACGACGCGCGCAGCGATTCACGCGGTGACCTG
CGCGGTGAGCCGGCCGACTATCCACCACCGGGATATCGCGGCGGGTACGCGGACGAACCACG
TTTCCGGCCCCGGGAGTTCGACCGCGCGGAGATGACACGGCCGCGCTTCGGATCGTGGCTGC
GCAACTCCACCCGCGGCGCGCTAGCGATGGACCCCCGCCGGATGGCGATGATGTTCGAGGAT
GGCCATCCGCTCTCGAAGATCACCACGCTGCGGCCCAAGGACTACAGCGAGGCTCGCACCATC
GGTGAGCGGTTCCGCGACGGCAGCCCGGTCATCATGGATCTGGTGTCGATGGACAACGCCGAT
GCCAAGCGGCTGGTCGATTTCGCGGCCGGCCTGGCCTTCGCGCTGCGCGGCTCGTTCGACAA
GGTCGCGACCAAGGTGTTCCTGCTCTCGCCTGCAGACGTCGATGTGTCCCCCGAGGAGCGCCG
CAGGATCGCCGAAACCGGGTTCTACGCCTACCAATAG

>Rv2148c - TB.seq 2406841:2407614 MW:27694
>emb|AL123456|MTBH37RV:c2407614-2406838, Rv2148c SEQ ID NO:74
ATGGCGGCGGATCTTTCGGCGTATCCAGACCGCGAATCGGAATTGACGCATGCGTTGGCGGCA
ATGCGATCGCGACTTGCGGCGGCCGCGGAGGCGGCGGGTCGCAATGTCGGCGAAATTGAACT
TCTACCGATTACCAAATTCTTTCCAGCAACCGATGTTGCGATTTTGTTTCGATTGGGTTGTCGGTC
CGTTGGCGAATCGCGCGAACAGGAAGCTTCAGCCAAGATGGCCGAACTTAATCGGTTGTTGGC
GGCTGCCGAGTTGGGTCACTCGGGGGGTGTGCACTGGCACATGGTGGGCCGGATTCAACGCA
ACAAAGCCGGGTCGCTGGCTCGCTGGGCGCACACCGCTCACTCGGTGGACAGCTCGCGGTTG
GTGACCGCGCTGGATCGGGCGGTTGTTGCGGCGCTGGCCGAACACCGTCGTGGCGAGCGGCT
GCGGGTTTACGTCCAGGTCAGCCTCGACGGTGACGGATCCCGGGGCGGCGTCGACAGCACGA
CGCCCGGCGCCGTAGACCGGATTTGCGCGCAGGTGCAGGAGTCAGAGGGCCTCGAACTGGTC
GGGTTGATGGGCATTCCGCCGCTGGATTGGGACCCGGACGAGGCCTTTGACCGGCTGCAATCG
GAGCACAACCGGGTGCGTGCGATGTTCCCGCACGCGATCGGTCTGTCGGCGGGCATGTCCAAC
GACCTTGAAGTCGCCGTCAAACATGGTTCGACCTGTGTGCGTGTCGGTACCGCGCTATTGGGTC
CGCGGCGGTTACGGTCACCGTGA

>Rv2150c ftsZ TB.seq 2408386:2409522 MW:38757
>emb|AL123456|MTBH37RV:c2409522-2408383, ftsZ SEQ ID NO:75
ATGACCCCCCCGCACAACTACCTGGCCGTCATCAAGGTCGTGGGTATCGGTGGTGGCGGTGTC
AACGCCGTCAACCGAATGATCGAGCAGGGCCTCAAAGGCGTGGAATTCATCGCGATCAACACC
GACGCCCAGGCGTTGTTGATGAGCGATGCCGACGTCAAACTCGACGTCGGCCGCGACTCCACC
CGCGGGCTGGGCGCCGGCGCCGATCCGGAGGTCGGCCGTAAGGCCGCCGAGGACGCCAAGG
ACGAGATCGAAGAGCTGCTGCGCGGTGCCGACATGGTGTTTGTCACCGCCGGCGAGGGGGGC
GGAACCGGCACCGGGGGGGCACCCGTCGTCGCCAGCATCGCCCGCAAGCTGGGCGCGTTGAC
CGTCGGTGTGGTCACCCGGCCGTTCTCGTTCGAGGGCAAGCGACGCAGCAATCAGGCCGAAAA
TGGCATCGCGGCGCTGCGGGAGAGTTGCGACACCCTCATCGTGATTCCCAACGACCGGTTGCT
GCAGATGGGAGATGCCGCGGTATCGCTGATGGATGCTTTCCGTAGCGCCGACGAGGTGCTGCT
CAACGGCGTGCAGGGCATCACCGACCTGATTACCACCCCGGGTCTAATCAACGTCGACTTCGC
CGACGTCAAGGGCATCATGTCCGGTGCCGGCACCGCACTGATGGGCATCGGCTCGGCCCGGG
GCGAAGGCCGGTCGCTCAAAGCGGCCGAGATCGCCATCAACTCGCCGTTGCTGGAAGCCTCGA
TGGAGGGCGCGCAAGGCGTGCTGATGTCGATCGCCGGCGGCAGCGACTTGGGCTTGTTCGAG
ATCAACGAGGCGGCCTCGTTGGTACAAGACGCCGCTCACCCCGATGCCAACATCATCTTCGGC
ACCGTCATCGACGATTCGCTCGGTGACGAGGTGCGGGTGACCGTGATCGCGGCCGGCTTCGAC
GTCAGCGGTCCCGGCCGCAAGCCGGTGATGGGCGAGACCGGCGGCGCCCACCGGATCGAGT
CAGCCAAGGCAGGCAAGCTCACCTCGACCTTGTTCGAGCCGGTCGACGCCGTCAGCGTGCCGT
TGCACACCAACGGCGCAACCCTGAGCATCGGCGGTGATGACGACGATGTCGACGTGCCGCCCT
TCATGCGCCGCTGA

>Rv2152c murC TB.seq 2410639:2412120 MW:51146
>emb|AL123456|MTBH37RV:c2412120-2410636, murC SEQ ID NO:76
GTGAGCACCGAGCAGTTGCCGCCCGATCTGCGGCGGGTGCACATGGTCGGCATCGGCGGAGC
TGGCATGTCGGGCATCGCCCGAATCCTGCTGGACCGCGGCGGGCTGGTCTCCGGGTCAGACG
CCAAGGAGTCGCGCGGTGTGCATGCGCTGCGGGCGCGGGGCGCGTTGATCCGGATCGGACAC
GACGCGTCGTCGCTGGACCTGTTGCCCGGTGGCGCCACGGCGGTCGTCACTACCCATGCCGC
CATCCCCAAAACCAACCCCGAGCTCGTCGAAGCGAGGCGCCGCGGCATTCCCGTGGTGCTGCG
GCCGGCCGTGCTGGCCAAGTTGATGGCCGGGCGCACCACATTGATGGTCACCGGCACGCACG
GCAAGACAACGACGACGTCCATGCTGATCGTCGCCCTGCAGCACTGCGGGCTTGACCCGTCCT
TTGCGGTCGGCGGTGAGCTGGGGGAGGCCGGTACCAACGCCCATCACGGCAGTGGCGACTGT
TTCGTCGCCGAAGCCGACGAAAGCGATGGCTCGCTGTTGCAGTACACACCCCACGTCGCGGTG
ATCACCAACATCGAGTCCGATCACCTGGACTTCTACGGCAGCGTCGAGGCGTATGTTGCGGTGT
TCGACTCCTTCGTGGAGCGCATTGTCCCCGGGGGTGCGCTGGTGGTGTGCACTGACGACCCCG
GAGGGGCCGCGCTGGCTCAGCGCGCGACTGAGCTGGGAATTCGAGTGCTGCGATACGGGTCG
GTGCCGGGTGAGACCATGGCAGCCACGTTGGTCTCGTGGCAGCAACAGGGGGTCGGCGCGGT
CGCACATATCCGGTTGGCCTCAGAACTAGCCACAGCACAGGGTCCCCGCGTGATGCGGCTGTC
GGTGCCCGGGCGACACATGGCGCTCAACGCGCTGGGAGCGCTGCTGGCCGCGGTGCAGATCG
GCGCCCCGGCCGACGAGGTGCTCGACGGGCTGGCCGGCTTCGAAGGAGTGCGGCGACGATTC
GAACTGGTTGGGACCTGCGGCGTCGGAAAGGCGTCGGTGCGCGTGTTCGATGACTACGCCCAC
CACCCGACGGAGATCAGCGCGACACTGGCGGCGGCGCGCATGGTGCTCGAACAGGGCGACGG
TGGCCGCTGCATGGTTGTGTTTCAACCCCATTTGTATTCGCGGACAAAGGCATTCGCTGCTGAG
TTTGGGCGTGCGCTGAATGCCGCTGACGAGGTGTTCGTACTCGACGTCTACGGAGCTCGTGAA
CAACCGCTGGCCGGTGTCAGCGGAGCCAGCGTCGCTGAGCACGTCACTGTGCCGATGCGCTA
CGTCCCGGATTTTTCGGCGGTCGCACAGCAAGTGGCCGCCGCCGCTAGTCCGGGCGACGTCAT
CGTCACGATGGGTGCCGGAGACGTGACCTTGCTGGGCCCGGAAATCCTGACCGCCCTTCGGGT
```

TABLE 3-continued

```
CCGGGCCAACCGAAGCGCCCCCGGCCGTCCGGGGGTGCTGGGATGA

>Rv2153c murG TB.seq 2412120:2413349 MW:41829
>emb|AL123456|MTBH37RV:c2413349–2412117, murG SEQ ID NO:77
GTGAAGGACACGGTCAGCCAGCCGGCCGGCGGGCGCGGGGCAACGGCGCCCCGGCCCGCCG
ATGCCGCCTCGCCGTCTTGTGGTTCCTCGCCGTCTGCTGATTCCGTGTCGGTCGTTCTCGCCGG
CGGCGGGACCGCCGGGCACGTCGAGCCCGCCATGGCCGTCGCCGACGCCTTGGTCGCGTTGG
ATCCGCGCGTCCGGATTACCGCGTTGGGCACCCTCCGTGGACTAGAGACCAGGCTGGTGCCCC
AGCGCGGCTACCACCTGGAGCTGATCACGGCGGTGCCGATGCCGCGCAAGCCCGGCGGCGAC
CTGGCCCGGCTGCCGTCGCGGGTGTGGCGCGCCGTCCGGGAGGCCCGGGACGTGCTCGACG
ATGTCGACGCCGACGTCGTCGTCGGTTTCGGTGGGTACGTCGCGCTACCGGCTTACCTAGCCG
CTCGCGGCCTGCCTTTGCCGCCCCGGCGCCGGCGCCGGATCCCGGTGGTGATCCACGAAGCC
AACGCCAGGGCGGGACTGGCCAACCGGGTCGGCGCCCATACCGCGGACCGGGTGCTCTCCGC
GGTGCCGGATTCCGGGCTGCGGCGCGCCGAGGTGGTTGGGGTCCCGGTCCGTGCGTCGATCG
CCGCGCTGGACCGCGCGGTGCTGCGAGCCGAGGCGCGGGCACACTTCGGCTTCCCCGACGAC
GCGCGGGTGCTGCTGGTGTTCGGGGGTTCGCAGGGCGCGGTCTCGCTCAACCGGGCGGTGTC
CGGCGCCGCCGCCGACCTGGCCGCCGCCGGTGTTTGCGTGCTGCATGCCCATGGACCCCAGA
ACGTGCTGGAGTTGCGCCGTCGGGCTCAAGGTGACCCACCGTACGTGGCGGTGCCCTATTTGG
ACCGGATGGAGCTGGCCTACGCCGCCGCCGATCTGGTGATCTGCCGGGCCGGGGCGATGACG
GTCGCCGAAGTATCCGCCGTCGGTCTGCCGGCCATCTACGTGCCGCTGCCGATCGGCAACGGT
GAACAGCGGCTGAATGCGTTGCCGGTAGTCAATGCCGGCGGCGGCATGGTGGTCGCCGACGC
CGCCCTGACCCCCGAGTTGGTGGCCCGCCAGGTTGCCGGGCTGCTCACCGACCCCGCGCGGC
TGGCCGCGATGACCGCGGCCGCAGCCAGGGTGGGACATCGCGATGCCGCGGGCCAGGTGGC
CCGGGCCGCGCTGGCCGTCGCCACCGGGGCCGGTGCCAGGACAACGACGTGA

>Rv2154c ftsW TB.seq 2413349:2414920 MW:56306
>emb|AL123456|MTBH37RV:c2414920–2413346, ftsW SEQ ID NO:78
GTGCTAACCCGGTTGCTGCGTCGGGGCACCAGCGACACCGACGGCTCCCAGACTCGAGGGGC
CGAGCCGGTCGAGGGGCAGCGGACGGGCCCGGAAGAAGCCTCTAACCCGGGTTCGGCGAGG
CCCCGCACCCGTTTCGGTGCCTGGCTGGGCCGTCCGATGACCTCGTTTCACCTCATCATCGCC
GTTGCCGCATTGCTGACCACCCTTGGACTGATCATGGTGCTGTCGGCATCGGCGGTGCGGTCC
TACGACGACGACGGATCGGCTTGGGTGATCTTCGGCAAGCAGGTCTTGTGGACGCTTGTGGGT
CTTATCGGCGGCTATGTCTGTCTGCGGATGTCGGTGCGGTTCATGCGGCGCATCGCCTTCTCCG
GTTTCGCGATCACCATCGTGATGCTGGTGCTGGTGCTGGTGCCGGGGATCGGCAAGGAGGCCA
ACGGCTCGCGCGGCTGGTTCGTGGTCGCGGGCTTCTCGATGCAGCCCTCTGAGCTGGCTAAGA
TGGCGTTCGCCATCTGGGGAGCGCATCTGCTGGCCGCCCGGCGCATGGAACGGGCTTCACTG
CGCGAGATGCTGATTCCACTGGTGCCGGCCGCCGTCGTTGCGCTGGCGCTGATCGTGGCCCAG
CCCGACCTCGGACAGACCGTGTCGATGGGCATCATCTTGTTGGGCCTGCTGTGGTATGCGGGG
CTGCCGCTGCGCGTCTTCCTCAGCTCACTGGCGGCGGTCGTCGTCTCGGCCGCCATCCTGGCG
GTGTCCGCGGGCTACCGATCCGACCGGGTGCGGTCGTGGCTCAACCCCGAAAACGATCCGCAA
GACTCCGGCTACCAGGCCCGACAGGCAAAGTTCGCGCTGGCTCAAGGTGGCATTTTCGGCGAC
GGTCTGGGCCAAGGCGTGGCCAAGTGGAACTACTTGCCCAACGCCCACAACGACTTCATTTTCG
CCATCATCGGCGAAGAGCTGGGTCTCGTCGGCGCGCTCGGACTGCTGGGGCTATTCGGATTGT
TCGCCTACACCGGCATGCGCATCGCTAGCCGGTCCGCCGACCCGTTCCTGCGGCTGCTGACCG
CCACCACGACACTGTGGGTGCTGGGACAGGCGTTCATCAACATCGGCTATGTGATCGGGCTGC
TGCCCGTCACCGGCCTGCAGCTGCCGCTCATCTCCGCCGGTGGAACCTCCACGGCCGCAACAC
TTTCGCTGATAGGCATCATCGCCAACGCGGCTCGCCACGAACCGGAGGCGGTGGCCGCGCTG
CGGGCTGGGCGCGACGACAAGGTGAACCGGTTGCTGCGGCTGCCGCTGCCCGAGCCGTATCT
GCCCCCTCGTCTCGAGGCGTTTCGTGACCGCAAGCGCGCCAACCCGCAACCGGCCCAAACGCA
GCCCGCGCGGAAGACCCCCCGCACGGCGCCCGGACAGCCTGCCCGGCAGATGGGCCTGCCC
CCGCGACCCGGCTCGCCCCGCACGGCCGATCCGCCGGTTCGTCGATCAGTGCATCATGGAGCT
GGCCAGCGGTACGCGGGCCAGCGTCGCACACGGCGCGTTCGGGCATTGGAAGGTCAGCGTTA
CGGGTGA

>Rv2155c murD TB.seq 2414935:2416392 MW:49314
>emb|AL123456|MTBH37RV:c2416392–2414932, murD SEQ ID NO:79
GTGCTTGACCCTCTGGGGCCGGGTGCGCCCGTGTTGGTAGCCGGTGGCCGGGTGACCGGTCA
GGCGGTGGCCGCGGTGCTGACTCGGTTTGGTGCGACGCCGACGGTGTGCGACGACGATCCGG
TCATGCTGCGACCGCACGCCGAACGTGGGCTGCCGACCGTTAGTTCCTCGGACGCGGTGCAGC
AGATAACCGGGTATGCGCTGGTGGTCGCCAGTCCCGGCTTCTCGCCCGCAACCCCGCTACTGG
CCGCGGCCGCGGCGGCGGGGGTGCCGATCTGGGGTGACGTGGAGTTAGCCTGGCGGCTAGA
CGCAGCGGGCTGCTACGGACCGCCGCGCAGCTGGCTGGTGGTGACCGGCACCAACGGCAAGA
CCACCACGACGTCGATGCTGCACGCCATGCTGATCGCCGGTGGCCGCCGCGCCGTGCTGTGC
GGCAATATCGGCAGTGCGGTGCTGGATGTGCTGGACGAGCCGGCCGAGCTGCTGGCCGTGGA
GTTGTCCAGTTTCCAGCTGCACTGGGCGCCGTCGCTGCGGCCCGAGGCCGGCGCGGTGCTCA
ACATTGCCGAAGACCACCTGGACTGGCATGCCACGATGGCCGAATACACCGCGGCCAAGGCCC
GGGTGCTGACCGGCGGGGTAGCGGTGGCCGGGCTGGATGACAGCCGAGCGGCCGCACTGCT
GGACGGCTCACCGGCGCAGGTGCGGGTCGGCTTCCGGCTCGGCGAGCCGGCCGCGCGGGAA
CTGGGCGTGCGCGACGCCCACCTGGTCGATCGCGCCTTCTCCGACGACTTGACGCTGCTGCCG
GTCGCGTCGATACCGGTGCCAGGTCCGGTCGGCGTGCTTGACGCCCTGGCCGCGGCGGCGCT
GGCCCGCTCGGTCGGGGTGCCCGCCGGTGCGATCGCCGACGCGGTCACGTCGTTTCGAGTGG
GCCGACACCGCGCCGAGGTGGTGGCCGTTGCCGACGGCATCACCTACGTGGACGACTCCAAG
GCCACCAACCCGCACGCCGCGCGGGCTTCGGTGCTTGCATACCCGAGGGTGGTATGGATCGC
CGGTGGCCTGCTCAAGGGCGCGTCGCTTCACGCCGAGGTTGCGGCGATGGCGTCGCGGCTGG
TCGGTGCGGTGCTGATCGGCCGGGATCGCGCAGCGGTTGCCGAGGCGTTATCACGACACGCG
CCCGATGTCCCAGTCGTTCAGGTTGTGGCAGGCGAGGATACTGGTATGCCTGCGACTGTTGAG
GTTCCTGTTGCTTGTGTTCTAGATGTGGCAAAAGATGACAAAGCCGGTGAGACCGTTGGCGCTG
CCGTGATGACCGCTGCGGTGGCCGCGGCCCGGCGGATGGCCCAACCCGGTGACACCGTGCTG
CTGGCACCGGCCGGCGCCTCATTCGACCAGTTCACCGGTTATGCCGACCGGGGCGAGGCATTC
```

TABLE 3-continued

```
GCGACCGCGGTCCGCGCGGTGATCCGGTAG

>Rv2156c murX TB.seq 2416397:2417473 MW:37714
>emb|AL123456|MTBH37RV:c2417473-2416394, murX SEQ ID NO:80
ATGAGGCAGATCCTTATCGCCGTTGCCGTAGCGGTGACGGTGTCCATCTTGCTGACCCCGGTG
CTGATCCGGTTGTTCACTAAGCAGGGCTTCGGCCACCAGATCCGTGAGGATGGCCCGCCCAGC
CACCACACCAAGCGCGGTACGCCGTCGATGGGCGGGGTGGCGATTCTGGCCGGCATCTGGGC
GGGCTACCTGGGCGCCCACCTAGCGGGCCTGGCGTTTGACGGTGAAGGCATCGGCGCATCGG
GTCTGTTGGTGCTGGGCCTAGCCACCGCTTTGGGCGGCGTCGGGTTCATCGACGATCTGATCA
AGATCCGCAGGTCGCGCAATCTCGGGTTGAACAAGACGGCCAAGACCGTCGGGCAGATCACCT
CCGCCGTGCTGTTTGGCGTGCTGGTGCTGCAGTTCCGGAATGCTGCCGGCCTGACACCGGGCA
GCGCGGATCTGTCCTACGTGCGTGAGATCGCCACCGTCACATTGGCGCCGGTGCTGTTCGTGT
TGTTCTGCGTGGTCATCGTCAGCGCCTGGTCGAACGCGGTCAACTTCACCGATGGCCTGGACG
GGCTGGCCGCCGGCACCATGGCGATGGTCACCGCCGCCTACGTGCTGATCACCTTCTGGCAGT
ACCGCAACGCGTGCGTGACGGCGCCGGGCCTGGGCTGCTACAACGTGCGCGACCCGCTGGAC
CTGGCGCTCATCGCGGCCGCAACCGCTGGCGCCTGCATCGGTTTTTTGTGGTGGAACGCCGCG
CCCGCCAAGATCTTCATGGGTGACACTGGGTCGCTGGCGTTGGGCGGCGTCATCGCGGGGTTG
TCGGTGACCAGCCGCACCGAGATCCTTGCGGTGGTGCTGGGTGCGCTGTTCGTCGCCGAGATC
ACCTCGGTGGTGTTGCAAATCCTGACCTTCCGGACCACCGGGCGCCGGATGTTTCGGATGGCG
CCCTTCCACCACCATTTCGAGTTGGTCGGTTGGGCTGAAACCACGGTCATCATCCGGTTCTGGC
TGCTCACCGCGATCACCTGCGGTCTGGGCGTGGCCTTGTTCTACGGTGAGTGGCTTGCCGCGG
TCGGTGCCTGA

>Rv2157c murF TB.seq 2417473:2419002 MW:51634
>emb|AL123456|MTBH37RV:c2419002-2417470, murF SEQ ID NO:81
ATGATCGAGCTGACCGTCGCGCAGATCGCCGAGATCGTCGGGGGCGCAGTGGCCGATATCTCC
CCGCAAGACGCCGCGCACCGCCGCGTCACCGGGACCGTCGAGTTCGACTCGCGCGCCATCGG
CCCGGGCGGGCTGTTCCTCGCCCTGCCGGGGGCGCGCGCCGACGGCCACGACCATGCCGCG
TCGGCGGTAGCCGCGGGCGCCGCCGTCGTGCTGGCCGCCCGCCCGGTGGGGGTGCCGGCCA
TCGTGGTTCCGCCAGTGGCCGCGCCGAACGTATTGGCCGGCGTCCTCGAGCACGACAACGAC
GGGTCGGGGGCGGCGGTGCTGGCCGCGCTGGCCAAGCTGGCCACCGCGGTGGCCGCGCAGT
TGGTGGCCGGCGGGCTCACCATCATCGGGATCACCGGCTCGTCGGGCAAGACGTCGACCAAG
GACCTGATGGCCGCCGTGCTGGCCCCGCTGGGGAGGTGGTGGCCCCGCCCGGATCGTTCAA
CAACGAGCTGGGTCACCCGTGGACGGTGCTGCGCGCGACGCGGCGCACCGACTACCTGATTTT
GGAGATGGCGGCACGCCATCACGGCAACATCGCCGCGCTCGCCGAGATCGCGCCCCCGTCGA
TCGGAGTCGTGCTCAACGTCGGCACCGCACATTTGGGTGAGTTCGGCTCCCGCGAGGTCATCG
CACAGACCAAAGCCGAACTGCCGCAGGCTGTTCCGCATTCCGGAGCGGTCGTCCTCAACGCTG
ATGACCCCGCGGTGGCGGCGATGGCCAAGCTGACCGCGGCCCGGGTGGTGCGGGTCAGCCG
GGACAACACCGGTGACGTTTGGGCGGGGCCGGTGTCGCTGGACGAATTGGCCAGGCCGCGCT
TTACGCTGCATGCCCACGATGCCCAAGCCGAGGTCCGACTCGGGGTCTGCGGCGACCACCAG
GTCACTAACGCGCTGTGCGCCGCGGCGGTCGCGCTGGAGTGTGGGGCCAGCGTTGAACAGGT
CGCGGCCGCGCTGACCGCGGCGCCGCCGGTGTCGCGGCATCGGATGCAGGTGACCACCCGC
GGCGACGGGGTGACGGTGATCGACGACGCCTACAACGCCAACCCCGACTCCATGCGGGCCGG
GCTGCAGGCGCTGGCCTGGATCGCGCACCAACCCGAGGCCACCCGCCGCAGCTGGGCGGTGC
TGGGTGAGATGGCCGAGCTGGGTGAGGACGCGATAGCCGAGCACGATCGCATCGGCCGGCTC
GCGGTGCGCTTAGATGTGTCTCGACTCGTTGTCGTGGGAACCGGGAGGTCGATCAGCGCCATG
CACCACGGAGCGGTCCTGGAGGGGGCGTGGGGCTCGGGGGAAGCCACTGCTGATCACGGTGC
GGATCGCACGGCCGTCAATGTGGCCGACGGTGACGCCGCCCTGGCACTACTGCGCGCCGAGC
TGCGACCCGGGGATGTGGTCTTGGTCAAGGCCTCGAACGCGGCCGGGCTGGGTGCGGTGGCC
GATGCATTGGTCGCAGACGACACATGCGGGAGTGTGCGCCCATGA

>Rv2158c murE TB.seq 2419002:2420606 MW:55310
>emb|AL123456|MTBH37RV:c2420606-2418999, murE SEQ ID NO:82
GTGTCATCGCTGGCCCGAGGGATCTCGCGGCGGCGAACGGAGGTGGCGACACAGGTGGAGGC
TGCGCCCACTGGCTTGCGCCCCAACGCCGTCGTGGGCGTTCGGTTGGCCGCACTGGCCGATCA
GGTCGGCGCGGCCCTGGCCGAGGGTCCAGCTCAGCGTGCCGTCACCGAGGACCGGACGGTCA
CCGGGGTCACGCTGCGCGCCCAGGACGTGTCACCCGGTGACCTGTTCGCCGCCCTGACCGGC
TCGACCACCCACGGGGCCCGCCACGTCGGCGACGCGATCGCACGCGGCGCCGTCGCGGTGCT
CACCGACCCCGCCGGGGTCGCCGAGATCGCCGGACGAGCGGCCGTGCCCGTGTTGGTGCACC
CCGCACCCCGCGGCGTGCTCGGCGGCTTGGCCGCCACCGTGTACGGGCATCCGTCCGAGCGG
TTGACGGTTATCGGGATCACCGGAACGTCCGGCAAGACCACCACCACCTATCTGGTCGAGGCC
GGGTTACGGGCTGCCGGACGCGTCGCCGGGCTGATCGGCACCATCGGCATCCGCGTCGGCGG
CGCCGACCTTCCCAGCGCGCTGACCACCCCGGAGGCCCCCACGCTGCAGGCGATGCTGGCGG
CGATGGTCGAACGCGGGGTGGACACCGTGGTCATGGAGGTGTCCAGCCACGCGCTGGCGCTG
GGCCGGGTGGACGGCACCCGGTTCGCCGTCGGCGCCTTCACCAATCTCTCCCGTGACCACCTG
GATTTCCACCCCAGCATGGCCGACTACTTCGAGGCCAAGGCGTCATTGTTCGATCCGGACTCGG
CACTGCGCGCGCCCGCACCGCCGTGGTGTGCATCGACGACGACGCCGGGCGCGCGATGGCGGC
GCGGGCCGCCGACGCGATCACCGTCAGCGCCGCCGACCGGCCCGCACACTGGCGCGCCACG
GATGTGGCGCCCACGGACGCGGGCGGGCAACAATTCACCGCCATCGACCCCGCCGGCGTAGG
GCATCACATCGGAATCCGGCTACCGGGCCGCTACAACGTCGCCAATTGCCTGGTCGCCCTGGC
GATTCTGGACACCGTCGGGGTCTCCCCGGAACAGGCGGTGCCGGGCCTGCGTGAGATCCGGG
TCCCGGGGCGGCTCGAGCAGATCGACCGCGGCCAGGGCTTTCTCGCGCTGGTCGACTACGCG
CACAAACCGGAAGCGCTGCGGTCGGTGCTGACCACCTTGGCGCACCCGGACCGCCGGCTGGC
GGTGGTGTTCGGCGCCGGCGGCGATCGTGACCCGGGCAAGCGGGCCCCGATGGGCCGGATA
GCCGCGCAGCTGGCCGACTTGGTGGTCGTCACCGACGACAACCCGCGTGACGAAGATCCCAC
GGCGATCCGCCGCGAAATCCTGGCTGGGGCGGCCGAAGTCGGCGGTGATGCCCAGGTCGTCG
AGATCGCAGACCGGCGGGACGCGATCCGGCACGCGGTTGCCTGGGCGCGCCCCGGCGACGT
GGTGCTCATCGCCGGCAAAGGCCACGAGACCGGGCAACGCGGCGGCGGGCGGGTCCGCCCG
TTCGACGACCGGGTGGAGCTGGCTGCCGCGCTAGAGGCCCTCGAGCGGCGCGCATGA
```

TABLE 3-continued

```
>Rv2159c - TB.seq 2420632:2421663 MW:36377
>emb|AL123456|MTBH37RV:c2421663-2420629, Rv2159c SEQ ID NO:83
ATGAAATTTGTCAACCATATTGAGCCCGTCGCGCCCCGCCGAGCCGGCGGCGCGGTCGCCGAG
GTCTATGCCGAGGCCCGCCGCGAGTTCGGCCGGCTGCCCGAGCCGCTCGCCATGCTGTCCCC
GGACGAGGGACTGCTCACCGCCGGCTGGGCGACGTTGCGCGAGACACTGCTGGTGGGCCAGG
TGCCGCGTGGCCGCAAGGAAGCCGTCGCCGCCGCCGTCGCGGCCAGCCTGCGCTGCCCCTGG
TGCGTCGACGCACACACCACCATGCTGTACGCGGCAGGCCAAACCGACACCGCCGCGGCGAT
CTTGGCCGGCACAGCACCTGCCGCCGGTGACCCGAACGCGCCGTATGTGGCGTGGGCGGCAG
GAACCGGGACACCGGCGGGACCGCCGGCACCGTTCGGCCCGGATGTCGCCGCCGAATACCTG
GGCACCGCGGTGCAATTCCACTTCATCGCACGCCTGGTCCTGGTGCTGCTGGACGAAACCTTC
CTGCCGGGGGGCCCGCGCGCCCAACAGCTCATGCGCCGCGCCGGTGGACTGGTGTTCGCCCG
CAAGGTGCGCGCGGAGCATCGGCCGGGCCGCTCCACCCGCCGGCTCGAGCCGCGAACGCTG
CCCGACGATCTGGCATGGGCAACACCGTCCGAGCCCATAGCAACCGCGTTCGCCGCGCTCAGC
CACCACCTGGACACCGCGCCGCACCTGCCGCCACCGACTCGTCAGGTGGTCAGGCGGGTCGT
GGGGTCGTGGCACGGCGAGCCAATGCCGATGAGCAGTCGCTGGACGAACGAGCACACCGCCG
AGCTGCCCGCCGACCTGCACGCGCCCACCCGTCTTGCCCTGCTGACCGGCCTGGCCCCGCAT
CAGGTGACCGACGACGACGTCGCCGCGGCCCGATCCCTGCTCGACACCGATGCGGCGCTGGT
TGGCGCCCTGGCCTGGGCCGCCTTCACCGCCGCGCGGCGCATCGGCACCTGGATCGGCGCCG
CCGCCGAGGGCCAGGTGTCGCGGCAAAACCCGACTGGGTGA

>Rv2163c pbpB TB.seq 2425049:2427085 MW:72506
>emb|AL123456|MTBH37RV:c2427085-2425046, pbpB SEQ ID NO:84
GTGAGCCGCGCCGCCCCCAGGCGGGCCAGTCAGTCGCAGTCGACGCGACCGGCGCGCGGTTT
GCGCCGGCCACCGGGAGCCCAGGAGGTTGGGCAACGCAAACGGCCCGGCAAAACGCAGAAAG
CCCGGCAAGCCCAGGAAGCCACGAAATCCCGCCCTGCGACACGGTCAGACGTCGCACCCGCG
GGTCGCTCGACTCGTGCGAGGCGCACCCGGCAGGTGGTGGACGTCGGACGCGCGGTGCGTC
GTTCGTCTTTCGGCATCGGACCGGAAACGCGGTCATCTTGGTGTTGATGTTGGTCGCGGCAACA
CAATTGTTCTTTCTGCAGGTATCACATGCCGCGGGCCTGCGTGCGCAGGCGGCCGGCCAACTC
AAGGTCACCGACGTCCAGCCAGCGGCTCGCGGCAGCATCGTCGACCGCAACAATGACCGGCTC
GCGTTCACCATCGAGGCGCGTGCCCTGACGTTCCAGCCGAAGCGGATTCGGCGGCAATTGGAA
GAGGCCAGGAAGAAGACGTCGGCTGCACCCGACCCGCAGCAGCGCCTGCGCGATATCGCCCA
GGAGGTCGCCGGCAAGCTGAACAACAAGCCAGATGCCGCGGCCGTGCTGAAGAAGCTGCAAA
GCGACGAGACCTTCGTCTACTTGGCGCGTGCGGTCGACCCGGCTGTCGCCAGCGCGATCTGCG
CGAAGTATCCCGAGGTCGGTGCGGAAAGACAGGATCTGCGTCAGTACCCGGGTGGGTCGCTG
GCGGCAAACGTCGTCGGTGGCATCGACTGGGATGGTCATGGGCTGCTGGGTCTGGAGGACTCC
CTGGATGCGGTGCTGGCCGGAACCGACGGATCGGTCACCTACGACCGTGGGTCAGACGGCGT
CGTCATCCCCGGCAGCTACCGGAATCGGCACAAGGCGGTCCACGGTTCCACCGTCGTGCTCAC
CCTCGACAACGACATCCAGTTCTACGTGCAGCAGCAGGTGCAGCAGGCCAAGAACCTATCGGG
GGCTCACAACGTCTCGGCCGTCGTCCTGGACGCCAAGACCGGCGAGGTGCTCGCGATGGCCA
ACGACAACACCTTCGACCCGTCGCAAGACATCGGGCGCCAGGGCGACAAGCAGTTGGGCAACC
CGGCGGTGTCGTCGCCCTTCGAGCCGGGCTCGGTGAACAAGATCGTCGCCGCGTCCGCGGTC
ATCGAGCACGGGTTGAGCAGCCCCGACGAGGTGCTACAGGTGCCTGGCTCGATCCAGATGGG
CGGTGTTACCGTGCATGACGCTTGGGAGCACGGCGTGATGCCCTATACCACCACGGGGGTGTT
CGGAAAGTCCTCCAACGTCGGCACGCTGATGCTTTCCCAACGTGTCGGACCGGAACGCTATTAC
GATATGCTCCGCAAGTTCGGGTTGGGACAGCGCACCGGCGTGGGCCTGCCCGGTGAGAGCGC
CGGACTGGTGCCGCCAATCGACCAGTGGTCGGGCAGTACGTTCGCTAATCTTCCTATTGGCCAA
GGTCTTTCGATGACTTTGCTGCAGATGACCGGCATGTACCAGGCCATCGCCAACGATGGAGTGC
GGGTACCCCCACGCATTATCAAGGCCACCGTCGCACCCGACGGCAGCCGAACCGAAGAACCGC
GCCCCGACGACATTCGCGTGGTGTCGGCGCAGACCGCCCAGACCGTGCGCCAGATGCTGCGT
GCCGTGGTGCAACGCGATCCGATGGGCTACCAGCAGGGTACCGGGCCGACGGCCGGGGTGCC
CGGCTATCAGATGGCCGGCAAGACCGGTACCGCGCAGCAGATCAACCCTGGCTGCGGCTGCTA
CTTCGACGACGTGTATTGGATCACCTTCGCCGGAATCGCCACTGCCGACAATCCCCGCTACGTG
ATCGGCATCATGTTGGACAACCCGGCGCGCAACTCCGACGGCGCGCCTGGGCACTCGGCCGC
CCCGCTGTTCCACAACATCGCGGGCTGGCTGATGCAGCGCGAAAACGTCCCGCTGTCACCCGA
TCCCGGGCCTCCTTTGGTCTTGCAGGCCACCTAG

>Rv2165c - TB.seq 2428236:2429423 MW:42498
>emb|AL123456|MTBH37RV:c2429423-2428233, Rv2165c SEQ ID NO:85
GTGCAAACCCGTGCACCGTGGTCTCTGCCCGAAGCGACCCTGGCGTACTTCCCCAACGCCAGG
TTCGTGTCTTCGGACAGGGACCTCGGTGCAGGGGCGGCGCCTGGAATAGCCGCGTCCCGAAGT
ACGGCTTGCCAGACCTGGGGAGGTATCACGGTGGCTGATCCAGGTTCGGGGCCAACCGGTTTC
GGTCATGTGCCGGTATTGGCGCAACGTTGCTTCGAACTGCTTACCCCCGCACTAACCCGCTACT
ATCCAGACGGCTCGCAGGCGGTCCTTCTCGACGCGACCATCGGCGCGGGCGGGCATGCGGAG
CGGTTTTTGGAGGGATTGCCGGGTCTGCGCCTGATCGGGCTCGACCGTGACCCAACCGCTCTG
GACGTCGCGCGGTCTCGGCTGGTGCGATTCGCTGACCGACTTACCCTGGTGCACACCCGCTAT
GACTGTCTGGGCGCAGCGCTGGCTGAATCCGGTTATGCCGCAGTGGGATCAGTCGACGGAATC
CTGTTCGATCTCGGCGTCTCATCCATGCAGCTCGACCGCGCCGAGCGGGGCTTCGCCTACGCC
ACGGACGCGCCATTGGACATGCGGATGGACCCGACGACGCCGTTGACCGCAGCTGACATTGTC
AACACTTACGACGAGGCGGCACTAGCCGACATCCTGCGTCGCTACGGAGAGGAGCGGTTTGCT
CGGCGCATCGCTGCCGGTATCGTCCGCCGACGCGCAAAAACCCCGTTCACCTCGACCGCCGAA
CTGGTTGCCCTGCTGTACCAGGCGATTCCAGCTCCGGCCCGGCGTGTCGGCGGGCATCCAGCC
AAGCGAACATTCCAGGCGCTGCGCATCGCGGTCAACGATGAGCTGGAATCGCTGCGCACGGCC
GTTCCTGCCGCGCTGGATGCCCTCGCTATCGGTGGGCGCATCGCGGTGCTGGCCTACCAGTCG
CTAGAGGACAGGATCGTCAAACGGGTGTTCGCCGAGGCAGTCGCGTCGGCCACCCCTGCGGG
ACTTCCGGTCGAACTTCCCGGCCATGAGCCGCGATTCCGTTCGTTAACGCACGGCGCCGAACG
AGCGAGTGTGGCTGAGATCGAACGCAATCCCCGCAGTACTCCAGTGCGGTTGCGGGCCCTGCA
ACGAGTCGAGCACCGGGCGCAATCGCAGCAATGGGCAACCGAGAAGGGTGATTCATGA
```

TABLE 3-continued

```
>Rv2166c - TB.seq 2429428:2429856 MW:15912
>emb|AL123456|MTBH37RV:c2429856-2429425, Rv2166c SEQ ID NO:86
ATGTTTCTCGGCACCTACACGCCCAAACTCGACGACAAGGGGCGGCTGACGCTGCCGGCCAAG
TTTCGCGACGCGTTGGCAGGGGGGTTGATGGTCACCAAGAGCCAAGATCACAGCCTGGCCGTT
TACCCGCGGGCGGCGTTCGAGCAGCTGGCGCGCCGGGCCAGCAAGGCGCCACGAAGCAACC
CCGAGGCGAGAGCGTTCCTACGTAATCTCGCCGCCGGTACCGACGAACAGCATCCCGACAGTC
AAGGCCGGATCACCTTGTCGGCCGACCACCGCCGCTACGCAAGCCTTTCCAAGGACTGTGTGG
TGATCGGCGCGGTCGACTATCTCGAGATCTGGGATGCGCAAGCCTGGCAGAACTACCAACAAAT
CCATGAAGAGAACTTCTCCGCGGCCAGCGATGAAGCACTCGGTGACATCTTCTGA

>Rv2197c - TB.seq 2461505:2462146 MW:22481
>emb|AL123456|MTBH37RV:c2462146-2461502, Rv2197c SEQ ID NO:87
ATGGTGAGCAGATATTCCGCATACCGGCGTGGGCCGGATGTAATCTCGCCGGACGTCATCGAT
CGCATCCTGGTTGGGGCATGTGCCGCGGTGTGGCTGGTGTTCACCGGCGTGTCGGTGGCCGC
CGCTGTCGCCCTGATGGACCTGGGTAGGGGCTTCCACGAGATGGCCGGAAACCCGCACACCAC
GTGGGTGCTGTACGCCGTAATTGTGGTCTCCGCACTGGTCATCGTGGGCGCGATACCGGTGCT
GTTGCGAGCTCGCCGCATGGCTGAGGCCGAGCCCGCGACGAGGCCGACGGGTGCATCCGTGC
GGGGCGGGCGATCGATCGGATCCGGGCATCCGGCGAAACGCGCTGTGGCCGAGTCGGCACCC
GTACAGCACGCGGATGCATTCGAGGTGGCCGCCGAGTGGTCCAGTGAGGCGGTGGACCGGAT
CTGGTTGCGCGGGACAGTCGTGTTGACCAGTGCGATTGGCATTGCGTTGATTGCCGTGGCGGC
GGCGACCTACCTCATGGCGGTCGGTCACGACGGGCCATCTTGGATCAGCTACGGGTTGGCCGG
GGTGGTCACCGCGGGCATGCCGGTGATCGAGTGGCTATACGCTCGGCAGCTGCGCCGGGTGG
TGGCGCCCCAGTCCAGTTAG

>Rv2198c - TB.seq 2462149:2463045 MW:30955
>emb|AL123456|MTBH37RV:c2463045-2462146, mmpS3 SEQ ID NO:88
ATGAGCGGGCCGAATCCCCCGGGACGGGAACCTGACGAACCCGAATCGGAACCCGTCAGCGA
CACGGGCGACGAACGGGCTTCCGGCAACCACTTGCCGCCCGTCGCCGGGGGCGGCGACAAAC
TGCCCAGTGACCAGACGGGCGAGACCGACGCATATTCTCGGGCATACTCTGCCCCGGAATCCG
AGCACGTCACCGGCGGCCCGTATGTGCCAGCCGATCTCAGGCTCTATGACTACGACGACTATG
AGGAGTCGTCCGACCTGGACGACGAACTGGCCGCTCCGCGCTGGCCGTGGGTGGTCGGTGTC
GCCGCCATAATTGCCGCCGTTGCGCTCGTGGTTTCGGTGTCGTTGCTCGTCACGCGACCACATA
CCAGCAAACTCGCCACCGGCGACACTACGTCCTCTGCACCGCCCGTGCAGGACGAAATCACGA
CCACCAAGCCGGCGCCGCCACCGCCGCCACCAGCCCCACCGCCCACCACCGAGATCCCGACA
GCGACGGAGACACAGACGGTCACTGTGACGCCGCCACCACCGCCCCCACCGGCGACAACCAC
GGCGCCGCCGCCGGCGACCACCACAACGGCGGCGGCACCGCCGCCCACGACCACCACGCCG
ACCGGTCCGCGGCAAGTCACCTATTCGGTGACCGGTACCAAGGCGCCGGGTGACATTATCTCG
GTGACTTACGTCGATGCCGCCGGGCGCCGACGGACACAGCACAATGTGTACATCCCGTGGTCC
ATGACGGTCACCCCGATCTCGCAATCCGACGTTGGCTCGGTGGAGGCCTCCAGCCTTTTCCGG
GTCAGCAAACTCAACTGCTCGATCACCACGAGCGACGGAACGGTGCTCTCATCGAACTCCAACG
ATGGACCGCAAACGAGCTGCTGA

>Rv2199c - TB.seq 2463234:2463650 MW:14866
>emb|AL123456|MTBH37RV:c2463650-2463231, Rv2199c SEQ ID NO:89
ATGCATATCGAAGCCCGACTGTTTGAGTTTGTCGCCGCGTTCTTCGTGGTGACGGCGGTGCTGT
ACGGCGTGTTGACCTCGATGTTCGCCACCGGTGGTGTCGAGTGGGCTGGCACCACTGCGCTGG
CGCTTACCGGCGGCATGGCGTTGATCGTCGCCACCTTCTTCCGGTTTGTGGCCCGCCGGTTAG
ATTCCCGGCCCGAGGACTACGAAGGCGCTGAAATCAGCGACGGCGCAGGAGAACTTGGATTCT
TCAGTCCGCATAGCTGGTGGCCGATCATGGTCGCGTTGTCCGGCTCGGTGGCAGCGGTCGGCA
TCGCGTTGTGGCTCCCGTGGCTGATCGCCGCCGGTGTGGCATTCATCCTCGCCTCGGCGGCCG
GATTGGTCTTCGAATATTACGTCGGTCCTGAGAAGCACTGA

>Rv2200c ctaC TB.seq 2463661:2464749 MW:40449
>emb|AL123456|MTBH37RV:c2464749-2463658, ctaC SEQ ID NO:90
GTGACACCTCGCGGGCCAGGTCGTTTGCAACGCTTGTCGCAGTGCAGGCCTCAGCGCGGCTCC
GGAGGGCCTGCCCGTGGTCTTCGACAGCTGGCGCTCGCAGCAATGCTGGGGGCATTGGCCGT
CACCGTCAGTGGATGCAGCTGGTCGGAAGCCCTGGGCATCGGTTGGCCGGAGGGCATTACCC
CGGAGGCACACCTCAATCGAGAACTGTGGATCGGGGCGGTGATCGCCTCCCTGGCGGTTGGG
GTAATCGTGTGGGGTCTCATCTTCTGGTCCGCGGTATTTCACCGGAAGAAGAACACCGACACTG
AGTTGCCCCGCCAGTTCGGCTACAACATGCCGCTAGAGCTGGTTCTCACCGTCATACCGTTCCT
CATCATCTCGGTGCTGTTTTATTTCACCGTCGTGGTGCAGGAGAAGATGCTGCAGATAGCCAAG
GATCCCGAGGTCGTGATTGATATCACGTCTTTCCAGTGGAATTGGAAGTTTGGCTATCAAAGGGT
GAACTTCAAAGACGGCACACTGACCTATGATGGTGCCGATCCGGAGCGCAAGCGCGCCATGGT
TTCCAAGCCAGAGGGCAAGGACAAGTACGGCGAAGAGCTGGTCGGGCCGGTGCGCGGGCTCA
ACACCGAGGACCGGACCTACCTGAATTTCGACAAGGTCGAGACGTTGGGCACCAGCACCGAAA
TTCCGGTGCTGGTGCTGCCGTCCGGCAAGCGTATCGAATTCCAAATGGCCTCAGCCGATGTGAT
ACACGCATTCTGGGTGCCGGAGTTCTTGTTCAAGCGTGACGTGATGCCTAACCCGGTGGCAAAC
AACTCGGTCAACGTCTTCCAGATCGAAGAAATCACCAAGACCGGAGCATTCGTGGGCCACTGCG
CCGAGATGTGTGGCACGTATCACTCGATGATGAACTTCGAGGTCCGCGTCGTGACCCCCAACG
ATTTCAAGGCCTACCTGCAGCAACGCATCGACGGGAAGACAAACGCCGAGGCCCTGCGGGCGA
TCAACCAGCCGCCCCTTGCGGTGACCACCCACCCGTTTGATACTCGCCGCGGTGAATTGGCCC
CGCAGCCCGTAGGTTAG

>Rv2427c proA g-glutamyl phosphate reductase TB.seq 2724231:2725475 MW:43746
>emb|AL123456|MTBH37RV:c2725475-2724228, proA SEQ ID NO:91
ATGACCGTGCCAGCACCGTCGCAGCTCGACTTGCGTCAAGAGGTGCACGACGCCGCACGCCG
CGCCCGGGTGGCCGCCCGCCGGCTGGCATCGCTGCCGACGACTGTCAAAGACCGCGCGCTGC
ACGCGGCTGCCGACGAGCTACTGGCTCACCGCGACCAGATCCTGGCGGCCAACGCCGAAGAC
CTGAACGCGGCGCGCGAGGCGGACACCCCGGCCGCCATGCTGGACCGGTTGTCCTTGAACCC
```

TABLE 3-continued

```
GCAACGAGTCGACGGTATCGCCGCCGGGTTGCGGCAAGTCGCGGGACTGCGCGATCCGGTCG
GTGAAGTGCTGCGTGGCTATACCCTGCCCAACGGGCTGCAGCTGCGCCAGCAGCGCGTCCCCC
TGGGCGTGGTCGGCATGATCTACGAGGGCCGCCCCAATGTCACCGTGGATGCCTTCGGGCTGA
CACTCAAGTCGGGTAACGCTGCATTGCTGCGCGGCAGCTCGTCGGCCGCAAAGTCCAACGAGG
CCCTGGTGGCGGTGTTACGCACCGCGCTGGTCGGCCTGGAGCTGCCGGCCGACGCGGTCCAG
CTGCTGTCGGCTGCCGACCGCGCCACCGTCACTCACCTGATTCAGGCCCGCGGCCTGGTCGAT
GTGGTGATTCCACGCGGGGGAGCGGGCCTGATCGAGGCGGTCGTACGCGATGCCCAGGTGCC
CACCATCGAGACCGGCGTCGGGAACTGCCATGTCTACGTGCACCAAGCGGCCGACCTGGACGT
GGCCGAGCGTATCTTGCTGAACTCCAAGACGCGGCGGCCCAGCGTCTGCAACGCCGCCGAGA
CGCTGCTGGTCGACGCAGCGATCGCCGAAACGGCGTTGCCTCGATTGCTGGCCGCCCTGCAGC
ACGCCGGTGTCACCGTACATCTCGACCCGGACGAGGCCGACCTGCGCCGCGAATACCTGTCGC
TGGACATCGCGGTGGCGGTGGTCGACGGTGTCGACGCTGCCATCGCCCATATCAACGAATACG
GCACCGGGCACACAGAAGCGATTGTGACCACCAATCTTGATGCGGCCCAACGCTTTACCGAACA
GATCGATGCGGCCGCGGTGATGGTGAACGCATCAACGGCGTTCACCGACGGCGAGCAATTCGG
CTTCGGCGCCGAGATCGGCATCTCCACCCAGAAACTGCATGCCCGCGGACCGATGGGACTACC
GGAATTGACGTCGACCAAGTGGATCGCATGGGGAGCCGGCCACACCCGTCCGGCCTGA
```

```
>Rv2438c - similar to YHN4_YEAST P38795 TB.seq 2734793:2737006 MW:80492
>emb|AL123456|MTBH37RV:c2737006-2734790, Rv2438c SEQ ID NO:92
ATGGGACTGCTCGGCGGCCAATCAGGGCCCAGGGTCGGCAGCGGCCCAGTCGGTAGCATCCC
CACGCCGGTCAATGCCGCCATCTGCCAGCAGCGCGGGGGATTCCACGGTGTCGAGCGTGGAT
ACTCGGCGGGTGATTCGGGCGTTCTGACGTCGCTGGGCGACAATGAAAGGACGATGAACTTTT
ACTCCGCCTACCAGCACGGGTTCGTGCGCGTTGCCGCCTGCACTCACCACACCACCATCGGTG
ACCCGGCGGCCAACGCCGCGTCGGTATTGGACATGGCCCGTGCGTGCCACGACGATGGCGCA
GCGTTGGCGGTCTTTCCTGAGCTGACGCTGTCGGGCTACTCCATCGAGGACGTACTACTGCAG
GACTCTCTGCTCGATGCCGTCGAGGACGCGCTGCTCGACCTGGTGACCGAATCCGCCGACCTG
TTACCTGTACTGGTGGTCGGGGCTCCGCTGCGGCATCGACACCGCATCTACAACACCGCGGTC
GTCATTCACCGCGGCGCCGTGCTCGGCGTGGTGCCCAAGTCGTATCTACCCACCTATCGCGAG
TTCTACGAGCGGCGCCAGATGGCGCCCGGAGACGGGGAGCGGGGCACGATCCGCATCGGTGG
CGCCGACGTGGCCTTCGGCACGGACCTGTTGTTCGCCGCGTCAGATCTACCCGGCTTTGTGTT
GCATGTGGAGATCTGCGAGGACATGTTTGTGCCGATGCCGCCCAGCGCCGAGGCGGCCCTGG
CGGGCGCGACGGTGCTGGCGAATCTGTCCGGCAGCCCGATCACCATCGGCCGTGCCGAGGAC
CGCCGGCTGCTTGCGCGCTCGGCGTCGGCGCGGTGTCTGGCTGCCTATGTCTATGCCGCCGC
GGGGGAGGGGGAGTCAACGACGGACCTGGCCTGGGACGGTCAGACGATGATCTGGGAGAATG
GCGCACTGCTCGCGGAGTCCGAACGTTTCCCCAAAGGAGTGCGCCGCAGTGTCGCCGACGTTG
ACACCGAGTTGCTTCGGTCGGAGCGGCTGCGGATGGGCACGTTCGACGACAACCGGCGTCAC
CACCGGGAGTTAACGGAATCGTTCCGGCGCATCGACTTCGCACTCGACCCACCGGCAGGCGAC
ATCGGACTGCTGCGCGAGGTCGAGCGGTTCCCGTTCGTTCCGGCCGATCCGCAACGATTGCAA
CAGGATTGCTACGAGGCCTACAACATCCAGGTGTCTGGACTCGAGCAACGGTTGCGGGCGCTG
GACTATCCGAAGGTCGTTATCGGTGTGTCCGGGGGATTGGACTCGACGCACGCGCTGATCGTC
GCGACCCATGCCATGGACCGCGAGGGCCGGCCGCGCAGCGACATTCTGGCGTTTGCGTTGCC
CGGATTCGCCACCGGGGAGCACACTAAGAACAACGCGATCAAGCTGGCACGTGCGCTGGGGG
TTACCTTCTCCGAAATCGATATCGGCGACACCGCTCGGTTGATGCTGCACACAATCGGCCATCC
GTATTCGGTTGGCGAAAAAGTGTACGACGTCACCTTCGAGAACGTCCAGGCCGGGTTGCGCAC
CGACTATCTTTTCCGTATCGCCAACCAGCGCGGGGGAATCGTACTGGGCACCGGGGACCTGTC
GGAGCTGGCACTGGGTTGGTCGACATACGGTGTCGGCGACCAGATGTCGCACTACAACGTCAA
CGCCGGTGTGCCCAAGACGCTGATCCAGCACCTGATCCGGTGGGTCATTTCGGCGGGTGAGTT
CGGTGAGAAGGTGGGTGAGGTATTGCAGTCGGTGCTCGACACCGAGATCACCCCCGAACTCAT
TCCGACCGGCGAGGAGGAGCTGCAGAGCAGCGAGGCCAAGGTCGGACCTTTCGCCCTACAGG
ACTTTTCGCTTTTTCAGGTACTGCGCTACGGATTTCGCCCGTCGAAGATTGCGTTTTTGGCCTGG
CATGCGTGGAACGATGCGGAGCGGGGCAACTGGCCGCCCGGCTTCCCAAAGAGCGAACGCCC
GTCCTATTCATTGGCCGAAATCCGGCATTGGCTGCAGATTTTCGTCCAGCGGTTTTATTCGTTTA
GCCAGTTCAAGCGTTCGGCATTGCCCAACGGCCCCAAGGTGTCCCACGGGGGCGCGTTGTCGC
CGCGTGGGGATTGGCGGGCCCCGTCGGATATGTCAGCGCGAATCTGGCTCGATCAGATCGACC
GTGAGGTGCCCAAGGGCTAG
```

```
>Rv2439c proB glutamate 5-kinase TB.seq 2737118:2738245 MW:38789
>emb|AL123456|MTBH37RV:c2738245-2737115, proB SEQ ID NO:93
ATGAGAAGTCCGCATCGGGACGCAATCCGGACCGCGCGCGGCCTTGTCGTGAAGGTCGGGAC
CACGGCGCTTACCACACCGTCCGGGATGTTCGATGCCGGCCGGCTGGCCGGACTGGCCGAGG
CGGTCGAGCGGCGGATGAAGGCGGGTTCCGACGTCGTCATCGTGTCTTCGGGCGCCATCGCC
GCCGGCATCGAGCCGCTCGGGCTGTCCCGTCGTCCCAAAGATCTGGCGACCAAGCAGGCGGC
GGCCAGCGTCGGGCAGGTCGCGCTGGTGAACTCGTGGAGCGCGGCGTTCGCCCGCTACGGCC
GCACGGTGGGCCAGGTGCTGCTGACCGCGCACGACATTTCGATGCGGGTGCAGCACACCAAC
GCCCAACGCACGCTGGATCGGCTGCGCGCGTTGCACGCGGTGGCGATTGTCAACGAGAACGA
CACCGTGGCCACCAACGAGATCCGGTTCGGTGACAACGATCGGCTGTCTGCACTGGTGGCGCA
CCTGGTCGGCGCCGACGCTTTGGTGCTGCTGTCGGACATCGACGGCCTCTACGACTGCGACCC
GCGCAAAACCGCGGACGCGACGTTCATTCCGGAGGTGTCCGGGCCGGCGGATCTGGACGGTG
TGGTCGCCGGCCGCAGTAGCCACCTGGGTACTGGCGGCATGGCGTCCAAGGTGGCGGCGGCG
CTGTTGGCCGCCGACGCCGGGGTGCCGGTACTGCTGGCCCCCGCGGCCGACGCCGCGACCG
CGCTCGCCGACGCGTCGGTGGGCACGGTGTTTGCGGCCCGGCCCGCGCGTCTGTCGGCCCGG
CGGTTCTGGGTGCGTTATGCCGCCGAAGCAACCGGCGCACTGACTCTCGACGCCGGTGCGGTG
CGCGCTGTGGTGCGACAACGCCGGTCACTGCTGGCGGCGGGTATCACCGCGGTGTCCGGCCG
GTTTTGCGGCGGCGATGTGGTCGAACTGCGTGCACCCGACGCGGCCATGGTAGCCCGCGGGG
TGGTTGCCTACGACGCGTCCGAGCTGGCCACCATGGTGGGCCGGTCCACCTCTGAGCTACCCG
GCGAGCTGCGCCGCCCGGTGGTGCACGCCGACGATCTGGTCGCGGTGTCGGCGAAGCAAGCT
AAGCAAGTTTAG
```

```
>Rv2440c obg Obg GTP-binding protein TB.seq 2738248:2739684 MW:50430
```

TABLE 3-continued

>emb|AL123456|MTBH37RV:c2739684–2738245, obg SEQ ID NO:94
GTGCCTCGGTTTGTCGATCGGGTCGTCATCCACACCAGAGCGGGTTCGGGCGGTAACGGCTGC
GCTTCGGTCCATCGCGAGAAATTCAAGCCGCTGGGCGGCCCCGATGGCGGAAATGGCGGCCG
GGGCGGCAGCATCGTCTTCGTCGTCGATCCGCAAGTGCACACCCTGCTCGACTTCCATTTCCGC
CCGCATCTCACCGCGGCTTCGGGCAAGCACGGGATGGGCAATAACCGCGACGGGGCCGCCGG
CGCGGATTTGGAAGTGAAAGTTCCCGAAGGCACCGTGGTATTGGACGAGAACGGCCGGCTACT
GGCCGACCTGGTCGGCGCGGGCACCCGCTTTGAAGCCGCCGCCGGAGGCCGTGGCGGTTTGG
GCAACGCCGCGCTGGCTTCCCGCGTGCGTAAGGCCCCCGGTTTCGCACTCCTCGGCGAAAAGG
GACAGTCCCGAGACCTCACCTTGGAACTCAAGACCGTCGCCGACGTCGGCCTGGTCGGGTTTC
CGTCGGCCGGAAAATCCTCGCTGGTGTCGGCGATTTCGGCGGCCAAGCCGAAGATCGCCGACT
ACCCGTTCACCACCCTGGTGCCCAACCTCGGTGTGGTCTCGGCTGGCGAGCACGCGTTCACCG
TCGCCGACGTGCCGGGGTTGATCCCGGGCGCATCCCGGGGCCGTGGTCTGGGGCTGGACTTT
CTGCGGCACATCGAGCGCTGCGCTGTACTGGTGCATGTGGTGGATTGCGCTACCGCCGAGCCG
GGCCGCGACCCCATCTCGGACATCGACGCGCTGGAAACGGAACTCGCGTGCTACACGCCCAC
GCTGCAAGGGGACGCGGCTCTGGGCGATCTCGCCGCACGGCCGCGTGCGGTGGTCCTCAACA
AAATCGATGTGCCGGAGGCCCGCGAGCTCGCGGAGTTCGTCCGTGACGACATCGCCCAGCGC
GGCTGGCCGGTGTTCTGCGTGTCGACCGCAACCCGGGAAAACCTGCAGCCGTTGATCTTTGGG
CTGTCGCAGATGATCTCGGACTACAACGCTGCGCGGCCGGTGGCGGTGCCACGGCGGCCGGT
GATTCGTCCGATTCCGGTGGACGACAGCGGTTTTACCGTCGAACCCGACGGGCATGGTGGCTT
TGTCGTCAGCGGTGCCCGGCCCGAGCGTTGGATTGACCAGACCAACTTCGACAACGACGAGGC
CGTCGGCTATCTCGCCGACCGGCTGGCGCGCCTGGGTGTCGAGGAGGAATTGCTGAGGCTGG
GTGCGCGGTCAGGATGCGCGGTGACCATCGGCGAGATGACGTTCGATTGGGAGCCGCAAACG
CCTGCGGGTGAGCCGGTCGCGATGTCCGGCCGGGGCACCGATCCGCGGCTGGACAGCAACAA
GCGGGTGGGCGCGGCCGAGCGAAAGGCCGCTCGGAGTCGGCGTCGCGAACACGGGGATGGC
TGA >Rv2441c rpmA 50S ribosomal protein L27 TB.seq 2739773:2740030 MW:8969
>emb|AL123456|MTBH37RV:c2740030–2739770, rpmA SEQ ID NO:95
ATGGCACACAAGAAGGGGGCTTCCAGCTCGCGCAACGGTCGCGATTCCGCCGCCCAGCGGCT
GGGGGTTAAGCGGTACGGCGGCCAGGTCGTCAAGGCCGGCGAGATCCTGGTCCGCCAGCGCG
GTACCAAATTCCATCCCGGCGTCAACGTCGGGCGTGGCGGCGATGACACCTTGTTCGCCAAGA
CGGCCGGGGCGGTCGAGTTCGGCATCAAACGCGGACGTAAGACGGTGAGCATCGTCGGTTCG
ACCACTGCCTGA >Rv2442c rplU 50S ribosomal protein L21 TB.seq 2740048:2740359 MW:11152
>emb|AL123456|MTBH37RV:c2740359–2740045, rplU SEQ ID NO:96
ATGATGGCGACCTACGCAATCGTCAAGACCGGCGGCAAGCAGTACAAAGTCGCTGTCGGAGAT
GTGGTCAAGGTCGAAAAGCTGGAATCCGAGCAGGGGGAGAAGGTGTCCCTGCCGGTGGCTCT
GGTTGTCGACGGCGCCACCGTCACCACCGATGCGAAGGCACTGGCCAAGGTCGCGGTGACCG
GTGAGGTGCTCGGGCACACCAAGGGCCCCAAGATCCGTATCCACAAGTTCAAGAACAAGACTG
GCTACCACAAACGGCAGGGACACCGTCAGCAGCTGACGGTCCTGAAGGTCACCGGCATCGCAT
AA >Rv2448c valS valyl-tRNA synthase TB.seq 2747596:2750223 MW:97822
>emb|AL123456|MTBH37RV:c2750223–2747593, valS SEQ ID NO:97
ATGCTGCCCAAGTCGTGGGATCCGGCCGCGATGGAGAGCGCCATCTATCAGAAGTGGCTGGAC
GCTGGCTACTTCACCGCGGACCCGACCAGCACCAAGCCGGCCTATTCGATCGTGCTGCCGCCG
CCGAACGTGACCGGCAGCCTGCACATGGGCCACGCGCTGGAACACACCATGATGGACGCCTTG
ACGCGGCGCAAGCGGATGCAGGGCTATGAGGTGCTCTGGCAGCCGGGCACCGACCATGCCGG
GATCGCCACCCAGAGCGTGGTCGAGCAGCAGCTGGCGGTCGACGGCAAGACTAAAGAAGACCT
CGGCCGCGAGCTGTTCGTGGACAAGGTGTGGGATTGGAAGCGAGAGTCTGGCGGTGCCATCG
GCGGCCAGATGCGCCGACTCGGTGACGGGGTGGACTGGAGCCGCGACCGGTTCACCATGGAC
GAAGGTCTGTCGCGGGCGGTGCGCACGATCTTCAAGCGGCTTTATGACGCCGGGCTGATCTAT
CGGGCCGAGCGGCTGGTCAACTGGTCGCCGGTGCTGCAGACCGCGATCTCCGACCTCGAGGT
CAACTACCGCGACGTCGAAGGCGAGCTGGTGTCGTTTAGGTACGGCTCGCTTGACGACTCGCA
ACCCCACATCGTGGTCGCCACCACCCGGGTCGAGACGATGCTGGGCGATACCGCGATCGCCGT
CCATCCCGATGACGAGCGCTACCGTCACCTGGTCGGCACCAGCCTGGCGCACCCATTCGTCGA
CCGGGAGCTGGCCATTGTCGCCGACGAGCACGTGGACCCTGAATTCGGCACCGGCGCGGTCA
AAGTCACACCCGCCCACGACCCCAACGACTTCGAAATCGGGGTGCGCCACCAGCTGCCGATGC
CCTCGATCCTGGACACCAAGGGCCGGATCGTCGACACCGGAACGCGATTCGACGGCATGGACC
GCTTCGAGGCACGGGTCGCGGTGCGCCAAGCGCTCGCGGCCCAGGGCCGCGTGGTCGAAGAA
AAGCGACCCTACCTGCACAGCGTCGGACACTCCGAACGCAGCGGCGAGCCGATCGAGCCGCG
GCTATCCCTGCAGTGGTGGGTCCGGGTGGAATCGCTGGCCAAAGCGGCCGGGGATGCGGTGC
GCAACGGGGACACCGTGATTCACCCGGCCAGCATGGAACCCCGCTGGTTCTCCTGGGTCGACG
ACATGCACGACTGGTGCATCTCGCGACAGCTCTGGTGGGGGCATCGGATCCCGATCTGGTACG
GACCCGACGGCGAACAGGTGTGCGTCGGCCCGGACGAAACACCCCCGCAGGGCTGGGAACAG
GATCCTGACGTGCTGGATACCTGGTTTTCGTCGGCGCTGTGGCCGTTTTCCACGCTGGGTTGGC
CGGACAAGACGGCGGAGCTGGAAAAGTTCTATCCGACAAGCGTTCTGGTTACCGGCTATGACAT
CTTGTTCTTTTGGGTGGCCAGAATGATGATGTTCGGCACCTTCGTCGGCGACGACGCCGCCATC
ACCCTCGACGGCCGCCGGGGCCCGCAGGTGCCGTTCACCGACGTGTTTCTGCATGGGCTGATC
CGCGACGAGTCTGGCCGCAAGATGAGCAAGTCCAAGGGCAACGTCATCGACCCGCTGGATTGG
GTGGAAATGTTCGGGGCCGATGCGCTGCGGTTCACGCTGGCCCGCGGGGCCAGTCCCGGTGG
TGACTTGGCGGTGAGCGAGGATGCCGTGCGGGCGTCGCGCAATTTCGGGACCAAGCTGTTCAA
CGCCACTCGGTACGCACTGCTCAATGGCGCCGCGCCAGCACCCCTGCCATCGCCGAACGAGCT
GACCGACGCCGACCGCTGGATTCTCGGAAGGTTGGAAGAGGTTCGGGCCGAAGTTGATTCGGC
CTTCGACGGATACGAGTTCAGCCGCGCTTGTGAGTCCCTGTATCACTTCGCCTGGGACGAATTC
TGCGACTGGTACCTCGAACTGGCCAAAACGCAGCTTGCCCAGGGACTCACACACACCACCGCC
GTGCTGGCCGCCGGGCTGGACACGCTGCTGCGCCTGCTGCACCCGGTGATTCCCTTCCTCACC
GAGGCGCTATGGCTGGCGCTGACCGGCAGGGAATCGCTGGTCAGCGCCGACTGGCCGGAGCC TABLE 3-continued

```
TTCCGGGATTAGCGTGGACCTTGTTGCCGCGCAACGGATTAACGATATGCAGAAGTTGGTGACC
GAAGTGCGGCGGTTCCGCAGCGATCAAGGTCTGGCCGACCGGCAGAAGGTTCCGGCCCGAAT
GCACGGTGTGCGGGACTCGGATCTGAGCAACCAGGTGGCCGCCGTGACCTCGCTGGCGTGGC
TCACCGAGCCGGGCCCGGATTTTGAGCCGTCGGTCTCGTTGGAGGTTCGGCTCGGCCCCGAGA
TGAACCGCACCGTCGTCGTCGAGCTCGACACCTCGGGCACCATCGACGTGGCCGCCGAGCGT
CGCCGCCTGGAAAAGGAGTTGGCCGGCGCCCAAAAGGAGCTGGCGTCGACCGCCGCCAAGTT
GGCCAACGCGGACTTTCTGGCCAAAGCGCCCGACGCCGTCATTGCCAAGATCCGGGACCGCCA
GCGCGTGGCGCAGCAGGAAACCGAGCGCATCACCACCCGGTTGGCTGCGCTGCAATGA
```

```
>Rv2482c plsB2 TB.seq 2786915:2789281 MW:88284 >emb|AL123456|MTBH37RV:c2789281—
2786912, plsB2 SEQ ID NO:98
GTGACCAAACCGGCGGCCGATGCCAGCGCGGTGCTTACTGCCGAGGACACACTGGTGCTGGC
TTCCACGGCGACGCCGGTCGAGATGGAGCTGATCATGGGCTGGCTGGGCCAGCAGCGTGCAC
GCCATCCGGACTCGAAGTTCGACATATTGAAGCTGCCACCGCGCAACGCTCCGCCGGCGGCGC
TGACGGCACTGGTCGAGCAGCTCGAGCCCGGCTTCGCATCCAGCCCGCAATCTGGCGAGGAC
CGTTCTATCGTGCCGGTTCGGGTGATCTGGCTGCCTCCCGCCGATCGCAGCCGGGCGGGCAAG
GTGGCCGCACTGCTCCCGGGTCGGGATCCCTACCATCCCAGCCAGCGTCAGCAGCGTCGCATC
CTGCGTACCGATCCCAGGCGCGCGCGGGTGGTGGCCGGCGAGTCGGCCAAGGTGTCCGAACT
GCGCCAGCAGTGGCGCGATACCACGGTGGCAGAGCACAAGCGCGATTTCGCCCAGTTCGTCAG
CCGCCGAGCGCTGTTGGCGCTGGCGCGCGCCGAATATCGGATCCTTGGACCGCAATACAAATC
TCCCCGGCTGGTGAAGCCGGAGATGTTGGCGTCCGCACGATTTCGTGCCGGCCTGGACCGGAT
TCCGGGCGCCACGGTCGAAGATGCCGGGAAGATGCTCGACGAACTCTCCACCGGATGGAGCC
AGGTGTCGGTAGACCTGGTTTCCGTCCTCGGCAGGCTGGCTAGCCGCGGCTTCGATCCGGAAT
TCGACTACGACGAGTATCAGGTCGCGGCGATGCGCGCCGCACTGGAGGCTCATCCGGCGGTC
CTGCTGTTCTCGCACCGGTCCTACATCGACGGCGTGGTGGTACCGGTGGCCATGCAGGACAAC
CGGTTACCGCCGGTGCACATGTTCGGCGGCATCAACCTGTCGTTCGGTCTCATGGGACCCCTC
ATGCGGCGCTCGGGGATGATCTTCATCCGGCGCAATATCGGCAACGACCCACTGTATAAGTACG
TGCTCAAGGAGTACGTGGGCTACGTGGTCGAGAAGCGGTTCAACCTGAGCTGGTCCATCGAAG
GCACCCGGTCGCGCACCGGAAAGATGTTGCCGCCCAAGCTCGGTTTGATGAGCTACGTGGCCG
ATGCTTACCTGGACGGCCGCAGTGACGACATCCTGCTGCAGGGGGTTTCGATTTGCTTCGATCA
GCTGCACGAGATCACCGAATACGCCGCCTACGCGCGTGGCGCGGAGAAGACGCCCGAAGGTT
TGCGCTGGCTCTACAACTTCATCAAGGCGCAGGGGGAACGCAACTTCGGCAAGATCTACGTTCG
CTTCCCCGAAGCGGTCTCGATGCGCCAGTACCTCGGCGCACCGCACGGCGAGCTGACCCAGG
ATCCGGCCGCGAAACGGCTTGCGTTGCAGAAGATGTCGTTCGAGGTGGCCTGGAGGATTTTGC
AGGCGACGCCGGTGACCGCGACGGGTTTGGTGTCCGCACTGCTGCTCACCACCCGCGGCACC
GCGTTGACGCTCGACCAGCTGCACCACACGTTGCAGGACTCACTGGACTATCTGGAACGCAAA
CAATCGCCGGTTTCGACAAGCGCATTGCGACTGCGCTCGCGCGAAGGCGTCCGTGCGGCGGC
GGACGCGTTGTCCAACGGCCACCCGGTCACTCGGGTCGACAGTGGCCGGGAGCCGGTATGGT
ACATAGCGCCTGACGACGAGCACGCCGCGGCGTTCTACCGGAACTCGGTGATCCATGCGTTTTT
GGAGACCTCGATCGTCGAGCTCGCGCTGGCCCATGCCAAGCACGCCGAAGGTGACCGCGTCG
CCGCGTTCTGGGCCCAGGCGATGCGGTTGCGGGATCTGCTGAAGTTCGACTTCTATTTCGCGG
ATTCCACGGCGTTTCGGGCCAACATCGCCCAAGAGATGGCCTGGCACCAAGACTGGGAGGATC
ATCTTGGCGTCGGGGGCAATGAGATCGACGCGATGCTGTATGCCAAACGGCCGCTGATGTCGG
ACGCGATGTTGCGGGTCTTCTTCGAAGCCTATGAGATCGTTGCCGACGTGTTGCGCGATGCTCC
GCCTGACATCGGTCCTGAGGAGTTGACGGAGCTGGCGCTCGGCCTCGGCCGTCAGTTTGTGGC
ACAGGGCCGGGTCCGCAGCAGCGAACCGGTATCGACGCTGCTGTTCGCCACTGCACGCCAGG
TCGCCGTCGATCAGGAGCTGATAGCGCCGGCGGCCGACCTCGCCGAACGTAGGGTCGCCTTC
CGGCGGGAGTTACGAAACATTCTGCGGGATTTCGACTATGTCGAGCAGATCGCGCGCAACCAG
TTCGTCGCCTGCGAGTTCAAAGCGCGTCAAGGACGCGACCGAATCTAA
```

```
>Rv2509 - putative oxidoreductase TB.seq 2824676:2825479 MW:28014
>emb|AL123456|MTBH37RV:2824676—2825482, Rv2509 SEQ ID NO:99
ATGCCGATACCCGCGCCCAGCCCCGACGCACGTGCCGTTGTCACCGGGGCTTCGCAGAACATC
GGCGCGGCGCTGGCCACCGAACTGGCCGCACGCGGGCACCACCTGATCGTCACCGCACGACG
CGAGGACGTGTTGACCGAGTTGGCTGCCCGGCTGGCCGACAAGTACCGCGTCACGGTCGACG
TGCGACCGGCCGATCTGGCCGATCCGCAAGAACGATCGAAACTGGCCGACGAGCTGGCTGCC
CGGCCCATCTCGATCCTGTGCGCCAACGCGGGTACCGCGACATTCGGCCCGATCGCATCGCTC
GATCTTGCCGGCGAAAAGACGCAGGTGCAGTTGAATGCCGTGGCGGTGCACGACCTTACGTTG
GCGGTGTTGCCGGGCATGATCGAGCGCAAGGCCGGCGGCATCTTGATTTCTGGTTCGGCGGCC
GGCAATTCACCGATTCCCTACAACGCCACCTATGCCGCGACCAAGGCCTTCGTGAACACCTTCA
GCGAATCTCTGCGCGGTGAGCTACGCGGCTCCGGCGTGCACGTCACGGTGCTGGCCCCGGGC
CCGGTTCGCACCGAGCTACCGGATGCCTCCGAAGCGTCACTGGTCGAGAAGCTGGTGCCGGAC
TTCCTGTGGATCTCGACGGAGCACACCGCCCGGGTATCGCTGAATGCCTTGGAGCGCAACAAG
ATGCGCGTCGTTCCGGGTCTGACGTCAAAGGCGATGTCGGTGGCCAGCCAATACGCTCCGCGC
GCCATCGTGGCGCCAATCGTGGGTGCCTTTTACAAGAGGCTTGGGGGCAGCTAG
```

```
>Rv2524c fas fatty acid synthase TB.seq 2840124:2849330 MW:326226
>emb|AL123456|MTBH37RV:c2849330—2840121, fas SEQ ID NO:100
GTGACGATCCACGAGCACGACCGGGTGTCCGCTGATCGCGGCGGGGACAGCCCGCATACCAC
CCACGCTCTGGTCGATCGCCTCATGGCTGGTGAGCCCTACGCTGTCGCATTCGGTGGCCAGGG
CAGCGCCTGGCTGGAAACCCTCGAAGAGCTGGTGTCGGCCACCGGGATAGAAACCGAGTTGGC
GACGTTGGTCGGTGAGGCAGAGCTGTTGCTCGATCCGGTCACCGACGAGCTGATTGTGGTGCG
CCCGATCGGTTTCGAGCCGCTGCAATGGGTACGCGCACTGGCGGCCGAGGACCCGGTTCCGT
CCGACAAGCACCTGACGTCGGCCGCCGTGTCGGTGCCCGGCGTGTTGCTTACCCAGATCGCGG
CGACCCGGGCGCTGGCCCGTCAAGGCATGGACCTCGTGGCCACCCCGCCGGTCGCCATGGCG
GGGCATTCGCAAGGTGTGCTGGCGGTGGAAGCCCTCAAGGCTGGTGGGGCACGCGACGTCGA
GCTGTTTGCCTTGGCCCAGTTGATCGGTGCCGCCGGAACGCTGGTGGCCCGCCGGCGCGGAA
TTTCCGTCCTGGGCGATCGCCCGCCGATGGTATCGGTCACCAACGCCGACCCCGAGCGCATCG
GCCGGTTGCTCGACGAGTTCGCCCAGGACGTGCGCACGGTGCTGCCACCGGTGTTGTCCATCC
```

TABLE 3-continued

```
GCAACGGCCGGCGTGCCGTCGTCATCACCGGCACCCCCGAGCAGCTGTCGCGTTTCGAGCTTT
ATTGCCGCCAGATCTCCGAGAAGGAAGAAGCCGACCGCAAGAACAAGGTCCGCGGCGGCGAC
GTCTTCTCGCCGGTCTTCGAGCCGGTGCAGGTGGAGGTGGGCTTTCACACCCCGCGGCTATCC
GACGGGATCGACATCGTCGCGGGCTGGGCCGAGAAGGCGGGCCTCGATGTCGCCTTGGCTCG
GGAGCTGGCCGATGCCATCTTGATCAGAAAGGTCGACTGGGTCGACGAGATCACCCGTGTCCA
CGCGGCCGGCGCCCGCTGGATCCTCGACCTGGGGCCGGGCGACATCCTGACCCGACTGACCG
CACCGGTGATCCGCGGCCTGGGCATCGGCATCGTGCCGGCGGCTACCCGCGGTGGCCAGCGC
AACCTGTTCACCGTCGGCGCCACCCCCGAGGTTGCCCGGGCCTGGTCGAGCTACGCACCGACC
GTGGTTCGCCTCCCCGACGGCAGGGTCAAGCTCTCGACGAAGTTCACCCGGCTGACCGGCCGC
TCGCCGATCCTGCTCGCGGGCATGACCCCGACCACCGTGGACGCCAAGATCGTCGCCGCGGC
GGCCAACGCCGGGCACTGGGCCGAGCTGGCCGGCGGCGGGCAGGTCACCGAAGAGATCTTC
GGTAACCGCATCGAACAAATGGCCGGCCTGCTCGAGCCGGGCCGCACCTATCAGTTCAACGCG
CTGTTCCTCGATCCCTACCTGTGGAAGCTTCAGGTGGGCGGCAAGCGGTTGGTGCAGAAGGCC
CGCCAGTCCGGCGCCGCGATCGACGGCGTGGTGATCAGCGCCGGCATCCCAGACCTCGACGA
GGCCGTCGAGCTGATCGACGAACTGGGCGACATCGGCATCAGCCACGTCGTGTTCAAACCCGG
GACCATCGAGCAGATCCGCTCGGTGATTCGCATCGCCACCGAGGTGCCCACCAAGCCGGTGAT
CATGCACGTCGAGGGCGGGCGCGCCGGCGGGCACCATTCCTGGGAGGATCTCGACGACCTGC
TGCTGGCTACCTACTCGGAGTTGCGCTCACGCGCCAACATCACGGTGTGCGTCGGCGGCGGCA
TTGGCACCCCGAGAAGGGCTGCGGAATATTTGTCCGGGCGCTGGGCGCAGGCCTACGGCTTCC
CATTGATGCCGATCGACGGCATCCTGGTCGGCACCGCGGCGATGGCCACCAAGGAATCCACCA
CGTCGCCATCGGTCAAGCGGATGCTCGTCGACACTCAGGGCACCGACCAATGGATCAGCGCCG
GAAAAGCGCAGGGCGGCATGGCCTCCAGCCGCAGTCAGCTCGGTGCCGATATCCACGAGATC
GACAACAGCGCATCCCGGTGCGGGCGGCTGCTCGACGAGGTGGCCGGTGACGCGGAGGCGG
TCGCGGAGCGTCGCGACGAGATCATCGCGGCGATGGCCAAGACCGCCAAGCCCTACTTCGGC
GACGTCGCCGACATGACCTACCTGCAGTGGCTGCGGCGCTACGTCGAACTGGCCATCGGGGAA
GGCAACTCGACCGCCGACACCGCCTCGGTGGGCAGCCCGTGGCTGGCCGACACCTGGCGGGA
CCGCTTCGAGCAGATGCTGCAGCGTGCCGAAGCCCGGTTGCACCCACAGGATTTCGGCCCGAT
CCAGACGCTATTCACCGATGCTGGCCTGCTGGACAATCCGCAGCAGGCGATCGCCGCCCTGCT
GGCGCGCTACCCCGACGCCGAGACCGTGCAGTTGCATCCCGCGGATGTGCCCTTTTTCGTGAC
GTTGTGCAAGACGCTGGGCAAGCCGGTCAACTTCGTGCCGGTGATCGACCAGGACGTGCGGC
GCTGGTGGCGCAGCGACTCGCTGTGGCAGGCCCACGACGCCCGCTACGACGCCGATGCGGTG
TGCATCATTCCGGGCACCGCGTCGGTAGCCGGCATCACCCGGATGGATGAACCCGTCGGTGAG
TTGCTGGACCGTTTCGAGCAAGCCGCAATCGATGAAGTGCTCGGCGCCGGTGTCGAGCCGAAG
GATGTCGCGTCGCGCCGGCTGGGCCGCGCCGACGTGGCCGGACCGTTGGCTGTCGTCCTCGA
CGCACCCGATGTGCGCTGGGCCGGTCGCACCGTGACCAACCCGGTGCATCGGATCGCCGACC
CGGCCGAATGGCAGGTGCACGATGGACCCGAAAACCCGCGCGCCACACACTCATCCACCGGC
GCCCGGCTGCAGACGCACGGCGACGACGTCGCCTTGAGCGTGCCCGTCTCGGGCACCTGGGT
CGACATCCGATTCACGTTGCCGGCCAACACCGTCGATGGCGGCACCCCGGTGATCGCCACCGA
GGACGCCACCAGCGCCATGCGCACGGTGCTGGCGATCGCCGCCGGTGTCGACAGCCCGGAGT
TCTTGCCTGCGGTGGCCAACGGGACGGCCACTTTGACGGTGGACTGGCACCCCGAGCGTGTTG
CCGACCACACCGGCGTCACCGCCACGTTCGGTGAGCCGCTGGCACCCAGCCTCACCAACGTG
CCCGACGCGCTCGTCGGCCCTTGTTGGCCAGCGGTTTTCGCGGCCATCGGATCGGCGGTCACC
GACACCGGTGAGCCGGTGGTGGAAGGCCTGCTGAGCCTGGTGCATCTGGACCACGCCGCCCG
CGTGGTCGGTCAGCTGCCCACGGTCCCGGCCCAATTGACCGTCACCGCAACGGCTGCCAACGC
AACCGATACGGACATGGGCCGCGTCGTGCCGGTCTCGGTCGTCGTTACCGGCGCCGATGGCG
CCGTGATCGCCACTCTCGAGGAGCGATTCGCGATCCTGGGTCGCACCGGTTCCGCCGAGCTCG
CCGACCCGGCGCGAGCCGGTGGCGCGGTGTCGGCGAACGCCACCGACACCCCGCGCCGTCG
CCGCCGCGACGTCACGATCACCGCGCCGGTCGACATGCGCCCGTTCGCGGTGGTGTCCGGCG
ACCACAACCCCATTCACACCGACCGGGCCGCCGCGCTGCTTGCCGGCCTGGAGTCGCCGATC
GTGCACGGCATGTGGCTGTCGGCCGCGGCGCAACACGCGGTGACCGCCACCGACGGGCAGG
CCCGGCCACCGGCCCGGCTGGTCGGCTGGACCGCGCGGTTTTTGGGCATGGTGCGCCCCGGC
GACGAGGTGGACTTCCGCGTCGAGCGCGTCGGAATCGACCAGGGCGCAGAGATTGTGGACGT
GGCCGCGCGCGTCGGGTCGGATCTAGTGATGTCGGCCTCCGCGCGACTGGCCGCACCCAAGA
CGGTCTACGCATTCCCCGGCCAGGGCATCCAACACAAGGGCATGGGCATGGAGGTGCGCGCC
CGCTCCAAGGCGGCCCGCAAGGTGTGGGACACCGCGGACAAGTTCACCCGCGACACCCTGGG
CTTCTCGGTACTGCACGTGGTCCGCGACAACCCGACCAGCATCATCGCCAGCGGTGTGCACTA
CCACCACCCCGACGGGGTGCTCTACCTGACGCAGTTCACCCAGGTCGCGATGGCGACGGTGG
CGGCCGCGCAGGTCGCCGAGATGCGTGAACAGGGAGCCTTCGTCGAAGGCGCCATCGCGTGC
GGCCACTCGGTCGGCGAGTACACCGCGCTGGCCTGCGTGACCGGCATCTACCAACTGGAAGC
CTTGCTGGAGATGGTGTTTCACCGCGGGTCGAAGATGCACGACATCGTTCCGCGCGACGAGCT
CGGCCGCTCCAACTATCGGCTGGCGGCCATCCGGCCGTCCCAGATCGACCTCGACGACGCCG
ACGTGCCCGCGTTCGTCGCCGGGATCGCGGAGAGCACCGGTGAATTCCTGGAGATCGTGAATT
TCAACCTGCGTGGCTCGCAATACGCGATCGCGGGCACGGTACGCGGCCTCGAGGCGCTCGAG
GCCGAGGTGGAGCGGCGCCGCGAGCTCACCGGCGGCCGACGGTCGTTCATTTTGGTGCCCGG
CATCGATGTTCCGTTCCACTCGCGAGTGCTGCGGGTCGGGGTGGCCGAATTCCGGCGCTCGCT
GGACCGGGTCATGCCGCGCGACGCGGACCCCGACCTGATCATCGGGCGCTACATTCCCAACCT
GGTGCCGCGGTTGTTCACCCTGGACCGCGACTTCATCCAGGAAATCCGGGATTTGGTGCCCGC
CGAGCCGCTCGACGAGATCCTCGCCGACTACGACACCTGGCTTCGCGAGCGTCCGCGCGAGAT
GGCGCGCACGGTGTTCATCGAGCTGCTGGCATGGCAATTCGCCAGCCCGGTGCGCTGGATCGA
GACGCAGGATCTGCTGTTCATCGAGGAGGCCGCCGGCGGGCTGGGTGTGGAGCGATTCGTCG
AGATCGGTGTGAAGAGCTCACCGACGGTGGCGGGTCTTGCCACCAACACCCTCAAACTGCCCG
AATACGCCCACAGCACAGTGGAAGTGCTCAACGCCGAGCGTGATGCCGCGGTGCTGTTCGCCA
CCGACACCGACCCGGAGCCGGAGCCGGAGGAAGACGAGCCGGTCGCGGAATCGCCCGCGCC
GGACGTCGTCTCGGAAGCCGCCCCGTCGCGCCGGCCGCTTCGTCGGCGGGCCCGCGTCCCG
ACGATCTGGTTTTCGACGCCGCCGATGCCACGCTGGCGCTGATCGCGCTCTCGGCCAAGATGC
GCATCGACCAGATCGAAGAACTCGACTCCATCGAGTCCATCACCGACGGTGCGTCGTCGCGGC
GCAACCAGCTGCTGGTGGACCTGGGCTCCGAGCTGAACCTCGGTGCCATTGACGGCGCCGCC
GAATCGGACCTGGCCGGTCTGCGCTCACAGGTGACCAAACTGGCGCGCACCTACAAGCCTTAC
GGCCCAGTGCTTTCCGACGCCATCAACGACCAGCTTCGCACCGTCCTCGGACCGTCGGGCAAG
```

TABLE 3-continued

CGGCCCGGCGCCATCGCCGAGCGGGTGAAGAAGACCTGGGAGCTCGGTGAGGGCTGGGCCA
AGCATGTCACCGTCGAGGTCGCGCTGGGCACCCGCGAGGGCAGCAGCGTTCGCGGCGGCGCC
ATGGGCCACCTGCACGAGGGCGCGCTGGCCGATGCCGCCTCCGTCGACAAGGTCATCGACGC
GGCGGTCGCATCGGTGGCCGCGCGCCAGGGCGTTTCGGTAGCGCTGCCGTCGGCCGGTAGTG
GTGGCGGCGCCACCATCGACGCGGCCGCGCTCAGCGAGTTCACCGACCAAATCACCGGCCGT
GAGGGCGTGCTGGCCTCCGCGGCCCGCCTGGTGCTGGGGCAGCTGGGACTGGACGACCCCGT
CAACGCCTTGCCGGCCGCCCCCGATTCCGAGCTGATCGACTTGGTCACCGCCGAACTGGGAGC
GGACTGGCCGCGGTTGGTGGCACCGGTGTTCGACCCCAAGAAGGCCGTCGTATTCGACGACC
GCTGGGCCAGCGCCCGCGAGGACCTGGTGAAGCTGTGGCTGACCGACGAGGGCGACATCGAC
GCCGACTGGCCGCGCCTGGCGGAGCGCTTCGAGGGTGCCGGCCACGTCGTGGCGACCCAGG
CTACCTGGTGGCAAGGTAAGTCGCTGGCCGCGGGCCGGCAGATCCATGCATCGCTGTACGGCC
GCATCGCCGCCGGCGCCGAGAACCCCGAACCCGGCCGCTACGGCGGCGAAGTTGCCGTGGTG
ACCGGCGCTTCGAAGGGTTCGATCGCCGCGTCGGTGGTGGCTCGGCTGCTCGACGGCGGAGC
CACCGTCATCGCGACCACCTCCAAGCTCGACGAGGAGCGGCTGGCGTTCTACCGCACGCTGTA
TCGCGACCACGCCCGTTACGGCGCGGCGCTGTGGCTGGTCGCGGCGAACATGGCGTCCTACT
CCGACGTCGACGCCCTGGTCGAATGGATCGGCACCGAACAGACCGAAAGCCTTGGGCCGCAGT
CGATTCACATCAAAGACGCGCAGACCCCGACGCTGCTGTTCCCGTTCGCGGCGCCACGCGTGG
TCGGGGACCTGTCGGAGGCCGGTTCGCGCGCCGAGATGGAGATGAAAGTGCTGCTGTGGGCC
GTGCAACGGCTGATCGGCGGCCTGTCGACGATCGGCGCCGAACGCGACATCGCGTCGCGGCT
GCACGTGGTGCTGCCCGGCTCGCCCAACCGTGGCATGTTCGGCGGCGACGGCGCCTACGGCG
AAGCCAAGTCCGCGCTGGATGCCGTGGTGAGCCGCTGGCACGCCGAGTCGTCCTGGGCGGCA
CGGGTCAGCCTGGCGCACGCGCTCATCGGCTGGACCCGCGGCACCGGGCTGATGGGCCACAA
CGATGCCATCGTGGCCGCCGTCGAAGAGGCCGGGGTCACCACCTACTCGACCGACGAGATGG
CGGCGCTGCTGCTCGACCTGTGTGATGCGGAATCCAAGGTGGCTGCGGCGCGTTCGCCGATCA
AGGCCGACCTGACCGGGGGCCTGGCCGAGGCCAACCTCGACATGGCCGAGCTGGCGGCCAAG
GCGCGCGAGCAGATGTCGGCAGCGGCGGCCGTCGACGAGGACGCCGAGGCCCCTGGCGCCA
TCGCCGCGCTGCCGTCGCCGCCCCGGGGTTTCACCCCCGCACCGCCGCCGCAATGGGACGAC
CTCGATGTCGACCCGGCCGACCTGGTGGTGATCGTCGGCGGCGCCGAAATCGGCCCGTACGG
CTCGTCACGCACCCGGTTCGAGATGGAGGTCGAAAACGAGCTGTCGGCGGCCGGCGTGCTGG
AGCTGGCCTGGACCACTGGGTTGATCCGCTGGGAGGACGACCCGCAACCCGGTTGGTACGACA
CCGAATCCGGCGAAATGGTCGACGAATCCGAGTTGGTGCAGCGCTACCACGACGCCGTGGTGC
AGCGCGTCGGCATTCGCGAATTCGTTGATGACGGCGCGATCGACCCCGACCACGCCTCGCCGC
TGCTGGTGTCGGTGTTCCTGGAGAAGGACTTCGCGTTCGTGGTGTCCTCGGAGGCCGATGCGC
GCGCCTTCGTCGAGTTCGATCCCGAGCACACGGTCATCCGGCCGGTGCCCGACTCCACCGACT
GGCAGGTCATCCGCAAGGCCGGCACCGAGATCCGGGTGCCGCGAAAGACCAAGCTGTCCCGC
GTCGTCGGCGGCCAGATCCCGACCGGGTTCGACCCGACGGTGTGGGGCATCAGCGCAGACAT
GGCCGGTTCCATCGACCGGTTGGCGGTATGGAACATGGTGGCGACCGTCGACGCGTTCCTGTC
GTCCGGTTTCAGCCCGGCCGAGGTGATGCGTTACGTGCACCCGAGTTTGGTGGCCAACACCCA
GGGCACCGGCATGGGCGGCGGCACGTCGATGCAGACGATGTACCACGGCAATCTGTTGGGCC
GCAACAAGCCGAACGACATCTTCCAGGAAGTCTTGCCGAATATCATTGCCGCGCACGTGGTTCA
GTCCTACGTCGGTAGCTACGGTGCGATGATCCACCCGGTAGCCGCGTGCGCCACCGCCGCGGT
GTCGGTCGAGGAAGGTGTCGACAAGATCCGGTTGGGCAAGGCTCAACTGGTGGTGGCCGGCG
GCCTGGATGACCTGACGCTGGAGGGCATCATCGGATTCGGTGACATGGCCGCCACCGCCGACA
CGTCCATGATGTGCGGCCGCGGCATCCACGACTCGAAGTTTTCCCGGCCCAACGACCGCCGCC
GTCTGGGCTTCGTCGAAGCCCAAGGCGGCGGGACGATCCTGTTGGCCCGCGGGGACCTGGCG
CTGCGGATGGGGCTGCCGGTGCTGGCGGTGGTGGCGTTCGCGCAGTCGTTCGGCGACGGCGT
GCACACCTCGATCCCGGCCCCGGGCCTGGGCGCGCTGGGGGCGGGCCGCGGCGGCAAGGAT
TCACCGCTGGCGCGGGCGCTGGCCAAGCTGGGCGTGGCCGCCGACGACGTGGCGGTCATCTC
CAAGCACGACACCTCGACGCTGGCCAACGATCCCAACGAGACCGAGTTGCATGAACGGCTCGC
CGACGCCCTGGGCCGTTCCGAGGGCGCCCCGCTGTTCGTGGTGTCGCAGAAGAGCCTGACCG
GCCACGCCAAGGGCGGCGCGGCGGTCTTCCAGATGATGGGGCTCTGCCAGATATTGCGGGAT
GGGGTGATCCCACCCAACCGCAGCCTCGACTGCGTCGACGACGAGCTGGCCGGCTCCGCGCA
TTTCGTGTGGGTGCGTGACACGTTGCGGCTCGGCGGCAAGTTCCCACTCAAGGCCGGCATGCT
GACCAGCCTCGGGTTCGGCCATGTGTCGGGCCTGGTCGCGTTGGTGCATCCGCAGGCGTTCAT
CGCCTCGCTGGATCCCGCACAGCGCGCGGACTACCAGCGGCGTGCCGACGCCCGCCTGCTGG
CCGGTCAGCGCCGGCTGGCCTCGGCGATTGCCGGTGGTGCGCCGATGTACCAGCGGCCCGGT
GACCGTCGCTTCGACCACCACGCGCCCGAGCGGCCGCAGGAGGCGTCGATGCTGCTGAATCC
GGCGGCCCGGCTGGGTGACGGCGAGGCGTATATCGGCTGA

>Rv2555c alaS alanyl-tRNA synthase TB.seq 2873772:2876483 MW:97326
>emb|AL123456|MTBH37RV:c2876483–2873769, alaS SEQ ID NO:101
GTGCAGACACACGAGATCAGGAAGCGGTTCCTCGATCATTTCGTGAAGGCGGGCCACACCGAG
GTGCCCAGCGCCTCGGTGATCCTCGACGACCCCAACCTGTTGTTCGTCAACGCCGGGATGGTC
CAGTTCGTGCCTTTCTTCTTGGGACAGCGCACGCCGCCGTACCCGACGGCCACCAGCATCCAG
AAGTGCATCCGTACCCCCGATATCGACGAGGTGGGCATAACCACCCGGCACAACACGTTTTTC
AGATGGCCGGCAATTTCAGCTTCGGCGACTATTTCAAACGCGGGGCCATTGAACTGGCCTGGG
CACTGCTGACCAACAGCCTCGCCGCCGGCGGCTACGGCCTGGACCCGGAAAGAATCTGGACG
ACAGTCTATTTCGACGACGACGAAGCTGTCCGGCTATGGCAGGAGGTTGCCGGGCTGCCGGCG
GAGCGAATCCAGCGCCGCGGCATGGCCGACAACTACTGGTCGATGGGCATTCCCGGACCGTG
CGGGCCGTCATCGGAGATCTATTACGACCGCGGACCCGAATTCGGTCCCGCAGGCGGTCCCAT
CGTCAGCGAAGACCGCTACCTCGAGGTCTGGAACCTGGTGTTCATGCAGAACGAGCGCGGAGA
GGGAACCACCAAGGAGGACTACCAGATCCTCGGGCCGCTGCCCCGCAAGAACATCGACACCG
GCATGGGCGTCGAGCGGATCGCGCTGGTGCTGCAAGACGTGCACAACGTCTACGAGACCGAC
CTGCTCAGGCCGGTCATCGATACCGTGGCCAGGGTCGCCGCGCGTGCCTACGACGTCGGCAA
CCACGAAGACGACGTGCGGTACCGCATCATCGCAGACCACAGCCGCACCGCCGCGATCCTGAT
CGGTGACGGCGTCAGCCCCGGCAACGACGGTCGCGGTTATGTGCTGCGCCGGCTGCTGCGTC
GGGTGATCCGCTCCGCCAAGCTGCTGGGCATCGACGCTGCGATCGTTGGCGACCTGATGGCCA
CGGTGCGCAACGCGATGGGCCCGTCATATCCCGAACTCGTCGCCGACTTCGAGCGGATCAGCC
GGATCGCGGTCGCCGAGGAGACGGCGTTCAACCGCACGCTGGCGTCGGGTTCCAGGCTGTTC TABLE 3-continued

```
GAGGAGGTGGCTAGCTCCACCAAGAAATCCGGAGCCACCGTGCTGTCCGGATCGGACGCTTTC
ACGTTGCATGACACCTACGGGTTCCCGATCGAGCTCACGCTGGAGATGGCGGCCGAAACCGGT
CTGCAGGTAGACGAAATCGGGTTCCGTGAGCTGATGGCCGAGCAGCGCCGCCGTGCCAAGGC
CGACGCCGCCGCGCGCAAACACGCGCATGCTGACCTGAGCGCCTACCGCGAGCTGGTTGACG
CCGGCGCCACCGAGTTCACCGGATTCGACGAGTTGCGTTCCCAGGCGCGGATTCTGGGCATCT
TCGTCGACGGTAAGCGGGTTCCGGTGGTGGCGCACGGTGTAGCCGGCGGAGCCGGGGAAGG
GCAGCGTGTCGAACTTGTCTTAGATCGCACCCCGCTCTACGCCGAATCGGGTGGGCAGATCGC
CGATGAGGGCACCATCAGCGGAACCGGTTCCAGCGAAGCTGCCCGGGCCGCGGTTACCGACG
TGCAGAAGATCGCCAAAACGCTTTGGGTGCACCGAGTCAACGTGGAATCCGGGGAATTCGTCG
AGGGTGACACCGTAATCGCGGCGGTGGATCCCGGGTGGCGCCGGGGTGCCACGCAGGGCCA
CTCGGGCACCCACATGGTGCATGCCGCGCTGCGACAAGTGCTGGGGCCCAACGCGGTTCAGG
CGGGATCGCTGAACCGGCCGGGATATTTGCGCTTCGACTTTAACTGGCAGGGTCCGTTGACCG
ACGACCAGCGCACCCAGGTCGAAGAGGTCACCAACGAGGCCGTGCAAGCGGACTTCGAGGTG
CGCACGTTCACCGAACAGCTCGACAAGGCCAAGGCGATGGGTGCCATCGCGCTGTTCGGCGAG
AGCTACCCCGACGAAGTGCGGGTGGTGGAGATGGGTGGACCGTTCTCGCTGGAGCTATGTGGC
GGCACCCATGTGAGCAACACGGCGCAGATCGGTCCCGTGACGATCCTGGGCGAGTCGTCGATC
GGCTCCGGGGTGCGCCGGGTGGAGGCCTACGTGGGGTTGGATTCGTTTCGTCACCTGGCCAA
GGAGCGTGCGTTGATGGCCGGGTTGGCCTCGTCACTGAAGGTGCCGTCCGAAGAGGTACCGG
CCCGGGTGGCCAATCTAGTGGAGCGCCTGCGGGCCGCCGAGAAGGAACTCGAACGTGTCCGG
ATGGCCAGCGCCCGGGCAGCCGCCACCAATGCCGCCGCCGGGGCTCAGCGGATCGGTAACGT
CCGTTTGGTGGCGCAGCGAATGTCCGGCGGGATGACCGCGGCAGACCTGCGGTCGTTGATCG
GCGACATCCGCGGCAAGCTGGGTAGCGAGCCGGCGGTGGTGGCGCTGATTGCCGAGGGCGAA
AGCCAAACTGTGCCGTATGCGGTCGCGGCCAATCCCGCTGCCCAGGACCTCGGAATCCGTGCC
AACGACCTGGTCAAACAACTTGCGGTGGCGGTCGAAGGCCGCGGTGGCGGTAAGGCGGACCT
GGCGCAGGGCTCGGGAAAGAATCCGACCGGTATCGACGCCGCGCTCGACGCGGTCCGCTCCG
AGATCGCCGTGATAGCGCGGGTCGGTTGA
```

```
>Rv2580c hisS histidyl-tRNA synthase TB.seq 2904822:2906090 MW:45118
>emb|AL123456|MTBH37RV:c2906090-2904819, hisS SEQ ID NO:102
GTGACGGAATTCTCTCGTCATTTTCGGCCCCCAAGGGGGTACCGGACTACGTCCCGCCCGACTCG
GCGCAGTTCGTCGCGGTGCGCGACGGGCTGCTCGCGGCGGCCCGTCAAGCCGGCTATAGCCA
CATCGAGCTGCCCATCTTCGAGGACACCGCCCTGTTCGCCCGGGGCGTGGGTGAATCCACCGA
CGTGGTGTCCAAGGAGATGTATACGTTCGCCGACCGTGGCGACCGCTCGGTGACGCTGCGGCC
CGAGGGCACCGCCGGGGTGGTGCGTGCGGTGATCGAACACGGGCTGGATCGCGGCGCGCTG
CCGGTGAAGTTGTGTTATGCGGGCCCGTTTTTCCGCTACGAGCGTCCGCAGGCCGGCCGGTAT
CGCCAGTTACAGCAAGTCGGGGTGGAGGCGATCGGCGTCGACGACCCGGCGTTGGACGCCGA
GGTGATCGCCATTGCCGACGCCGGGTTCCGCTCGTTGGGTCTCGACGGGTTCCGGCTGGAAAT
CACCTCCCTGGGAGACGAGAGTTGCCGTCCGCAGTACCGGGAACTGTTGCAGGAGTTCTTGTTT
GGACTCGATCTCGACGAGGACACCCGCAGGCGCGCAGGGATCAATCCGCTGCGGGTGCTCGA
CGACAAGCGACCCGAATTGCGTGCGATGACGGCGTCGGCGCCGGTGTTGCTGGATCATCTGTC
TGATGTCGCCAAGCAGCATTTCGACACCGTGCTCGCCCATCTGGACGCGCTTGGAGTGCCCTAT
GTCATCAACCCGCGCATGGTGCGCGGCCTGGACTACTACACCAAGACCGCCTTCGAGTTCGTC
CATGACGGGCTTGGTGCGCAATCGGGGATCGGCGGCGGGGGGCGCTACGACGGCCTGATGCA
CCAGCTTGGCGGGCAGGACTTGTCGGGCATCGGGTTCGGGCTGGGCGTGGACCGGACCGTGC
TGGCGCTGCGGGCCGAGGGCAAGACGGCGGGGGACAGCGCCCGGTGCGACGTGTTCGGCGT
GCCGCTTGGCGAGGCGGCCAAGCTCAGGCTGGCGGTGCTGGCTGGACGACTGCGCGCGGCC
GGGGTGCGGGTTGACCTTGCCTATGGTGATCGCGGGCTCAAAGGCGCGATGCGCGCGGCCGC
TCGTTCCGGCGCCCGTGTTGCGTTGGTAGCGGGCGACCGCGACATCGAGGCCGGGACGGTCG
CAGTGAAGGACTTGACGACGGGTGAGCAAGTTTCGGTCTCGATGGATTCGGTTGTGGCCGAAG
TAATTTCGCGGCTGGCTGGGTAG
```

```
>Rv2614c thrS threonyl-tRNA synthase TB.seq 2941190:2943265 MW:77123
>emb|AL123456|MTBH37RV:c2943265-2941187, thrS SEQ ID NO:103
ATGAGCGCCCCCGCACAACCCGCCCCGGGAGTCGATGGCGGCGACCCGTCGCAAGCCCGAAT
TCGGGTTCCTGCCGGGACCACCGCGGCCACCGCCGTCGGCGAAGCGGGTTTACCGCGGCGCG
GTACGCCCGATGCGATCGTCGTCGTGCGCGACGCCGACGGCAACCTGCGCGACCTGAGCTGG
GTGCCCGACGTCGACACCGATATCACGCCGGTGGCCGCCAACACCGACGACGGTCGCAGCGT
GATCCGCCATTCGACCGCGCACGTGTTGGCCCAAGCCGTCCAAGAGCTGTTTCCGCAGGCCAA
GCTCGGCATCGGACCACCCATCACCGACGGCTTCTACTACGACTTCGACGTGCCCGAGCCGTT
CACGCCCGAGGACTTGGCGGCGCTGGAAAAGCGGATGCGCCAGATCGTCAAGGAAGGCCAGC
TGTTCGACCGGCGGGTCTACGAATCCACCGAACAGGCCCGCGCCGAGCTGGCCAACGAGCCC
TACAAGCTGGAACTCGTCGACGACAAATCGGGTGACGCCGAGATCATGGAGGTCGGCGGTGAC
GAGCTCACCGCCTACGACAACCTCAACCCCCGCACCCGCGAGCGCGTCTGGGGCGACCTGTG
CCGCGGACCGCACATCCCGACCACCAAACACATCCCGGCGTTCAAGCTCACCCGCAGCTCGGC
CGCCTACTGGCGGGGCGATCAGAAAAACGCCAGCCTGCAACGGATCTACGGCACCGCGTGGG
AATCCCAGGAGGCGCTCGACAGGCACCTGGAGTTCATCGAAGAGGCGCAGCGCCGCGACCAC
CGCAAGCTGGGTGTCGAGCTGGACCTGTTCAGCTTCCCCGACGAAATCGGTTCCGGCCTAGCG
GTTTTCCACCCCAAGGGCGGCATCGTGCGTCGCGAACTGGAGGACTACTCGCGGCGCAAGCAC
ACCGAGGCGGGCTACCAGTTCGTCAACAGCCCGCACATCACCAAGGCCCAGTTGTTCCACACC
TCGGGACATCTGGACTGGTACGCCGACGGCATGTTCCCCCCGATGCACATCGACGCGGAGTAC
AACGCCGACGGCTCGCTGCGCAAACCCGGCCAGGACTACTACCTCAAGCCGATGAACTGCCCG
ATGCACTGCCTGATCTTCCGCGCGCGCGGGCGATCCTATCGGGAACTGCCGTTGCGGCTCTTC
GAGTTCGGCACGGTGTATCGCTACGAGAAGTCCGGTGTGGTGCACGGGTTGACCCGGGTGCGT
GGGCTGACCATGGACGACGCGCACATCTTCTGCACCCGCGACCAGATGCGCGACGAGCTGCG
GTCGCTGCTGCGGTTTGTGCTCGACCTGCTCGCCGACTACGGCCTCACCGACTTCTACCTCGAA
CTGTCCACCAAGGACCCGGAGAAGTTCGTCGGCGCCGAGGAGGTCTGGGAGGAAGCCACCAC
CGTGCTGGCCGAGGTGGGCGCCGAATCCGGGCTGGAGCTGGTGCCCGATCCAGGCGGCGCG
GCGTTCTACGGGCCCAAGATTTCAGTGCAGGTCAAAGACGCGCTGGGCCGCACCTGGCAGATG
TCGACCATCCAGCTGGACTTCAACTTTCCGGAACGTTTCGGCCTGGAGTACACCGCCGCCGACG
```

TABLE 3-continued

GAACCCGCCACCGCCCGGTGATGATCCACCGCGCGCTATTTGGGTCGATCGAGCGGTTCTTCG
GCATTCTCACCGAGCACTACGCGGGGGCGTTCCCGGCCTGGTTGGCGCCCGTGCAGGTGGTC
GGCATCCCGGTCGCCGATGAGCACGTCGCCTATCTGGAAGAGGTTGCCACGCAACTGAAGTCG
CACGGGGTGCGGGCCGAGGTGGACGCCAGCGACGATCGGATGGCCAAGAAGATCGTGCACCA
CACCAACCACAAGGTGCCGTTCATGGTGTTGGCGGGTGATCGTGACGTCGCCGCCGGCGCGGT
GAGTTTCCGGTTCGGTGACCGCACCCAAATCAACGGTGTGGCCCGTGACGATGCGGTGGCGGC
CATTGTCGCCTGGATCGCTGACCGCGAAAATGCGGTTCCTACAGCGGAACTGGTGAAAGTGGC
CGGTCGTGAGTGA

>Rv2697c dut deoxyuridine triphosphatase TB.seq 3013683:3014144 MW:15772
>emb|AL123456|MTBH37RV:c3014144–3013680, dut SEQ ID NO:104
GTGTCGACCACTCTGGCGATCGTCCGCCTCGACCCCGGGCTCCCGCTGCCCAGCCGCGCTCAC
GACGGCGACGCCGGCGTTGATCTCTACAGCGCCGAAGACGTCGAGCTGGCACCTGGGCGCCG
CGCCCTGGTACGGACGGGTGTTGCGGTCGCCGTCCCGTTCGGCATGGTCGGGCTGGTCCATC
CGCGCTCCGGGTTGGCCACGCGGGTGGGGCTTTCGATCGTCAACAGTCCGGGCACCATCGAC
GCGGGTTATCGTGGGGAGATCAAGGTGGCCCTGATCAACTTGGACCCAGCCGCGCCCATCGTG
GTACATCGCGGTGACCGAATCGCCCAGTTGCTAGTGCAACGGGTTGAGTTGGTCGAGCTGGTC
GAGGTCTCGTCGTTCGACGAGGCCGGGCTGGCCTCGACATCCCGCGGCGACGGTGGCCACGG
TTCCTCCGGCGGACATGCGAGTTTGTGA >Rv2782c pepR protease/peptidase, M16 family (insulinase) TB.seq 3089045:3090358 MW:47074
>emb|AL123456|MTBH37RV:c3090358–3089042, pepR SEQ ID NO:105
ATGCCGCGACGGTCACCAGCTGACCCCGCGGCGGCGCTGGCGCCGCGGCGCACCACCCTGC
CGGGCGGGCTGCGAGTGGTCACCGAATTCCTGCCCGCGGTGCACTCCGCGTCGGTCGGGGTG
TGGGTCGGCGTCGGATCGCGCGACGAAGGCGCCACGGTGGCCGGGGCGGCGCACTTCCTTGA
GCATTTGCTGTTCAAGTCGACGCCCACCCGCTCTGCCGTGGACATTGCGCAGGCGATGGACGC
GGTGGGCGGGGAACTGAACGCATTCACCGCCAAGGAGCACACCTGCTACTACGCCCACGTGCT
CGGCAGCGACTTGCCGTTGGCCGTCGACCTGGTCGCCGATGTGGTGCTCAACGGCCGCTGTGC
CGCCGACGATGTCGAGGTGGAACGTGACGTCGTCCTCGAGGAGATCGCGATGCGCGACGACG
ACCCCGAGGACGCCTTGGCGGACATGTTCCTGGCGGCGTTGTTCGGCGACCACCCGGTCGGTC
GCCCGGTGATCGGCAGCGCGCAATCCGTGTCGGTGATGACGCGGGCTCAACTGCAATCGTTTC
ACCTGCGGCGCTATACCCCGGAGCGGATGGTCGTCGCGGCCGCCGGCAATGTGGATCACGAC
GGGCTGGTTGCGTTGGTCCGCGAGCACTTCGGGTCCCGGTTGGTCCGGGGGAGACGGCCAGT
TGCGCCGCGCAAGGGTACCGGCCGGGTCAACGGCAGCCCCCGGTTGACACTGGTTAGCCGCG
ACGCCGAACAGACGCATGTGTCGCTGGGCATCCGCACACCCGGGCGCGGCTGGGAGCATCGT
TGGGCACTGTCGGTGCTGCACACCGCGCTGGGCGGTGGCTTGAGTTCCCGGCTGTTCCAGGAG
GTCCGCGAGACCCGCGGGCTGGCCTACTCGGTCTACTCCGCGCTGGATCTCTTCGCCGACAGC
GGCGCGCTTTCGGTGTACGCGGCCTGCCTGCCCGAACGCTTCGCCGACGTGATGCGGGTGAC
CGCCGATGTGCTGGAAAGCGTGGCACGCGACGGCATCACCGAGGCGGAATGCGGCATCGCCA
AGGGATCGCTGCGGGGTGGGCTGGTGCTAGGGCTGGAGGATTCCAGCTCCCGGATGAGCCGG
CTCGGCCGCAGCGAGTTGAACTACGGCAAGCACCGCAGCATCGAACACACCTTGCGGCAAATC
GAGCAGGTCACCGTGGAGGAGGTCAACGCGGTGGCCCGCCACCTGCTGAGCAGGCGCTACGG
TGCTGCCGTTCTTGGCCCACACGGATCGAAACGATCACTGCCGCAACAACTTCGAGCGATGGTA
GGGTAG >Rv2783c gpsI pppGpp synthase and polyribonucleotide phosphorylase TB.seq
3090339:3092594 MW:79736 >emb|AL123456|MTBH37RV:c3092594–3090336, gpsI
SEQ ID NO:106
ATGTCTGCCGCTGAAATTGACGAAGGCGTGTTCGAGACGACCGCCACCATCGACAACGGGAGC
TTTGGCACCCGGACCATCCGCTTCGAGACCGGCCGATTGGCCTTGCAGGCCGCCGGCGCGGT
GGTCGCCTACCTCGACGACGACAACATGCTGCTGTCGGCGACCACCGCCAGCAAGAACCCCAA
AGAACACTTCGACTTCTTCCCCCTCACGGTCGACGTCGAGGAGCGCATGTATGCGGCCGGCCG
CATCCCCGGTTCGTTCTTCCGTCGCGAGGGCCGACCCTCCACCGACGCGATCCTGACCTGCCG
GCTCATCGACCGCCCGCTGCGCCCGTCGTTTGTCGACGGGCTGCGCAACGAGATCCAAATCGT
GGTGACGATTCTCAGCCTGGATCCGGGCGATCTCTACGACGTATTGGCGATCAACGCGGCGTC
GGCGTCCACCCAGCTGGGCGGTCTGCCGTTCTCCGGGCCCATCGGCGGTGTGCGGGTGGCGC
TCATCGACGGCACCTGGGTCGGCTTCCCCACCGTCGACCAGATCGAGCGCGCCGTGTTCGACA
TGGTCGTGGCCGGCCGGATCGTCGAGGGTGATGTTGCCATCATGATGGTCGAAGCCGAGGCCA
CCGAAAACGTCGTCGAGCTCGTCGAAGGTGGTGCCCAAGCGCCGACGGAAAGCGTGGTGGCC
GCGGGCCTGGAGGCGGCCAAGCCGTTTATCGCCGCGCTGTGCACCGCGCAGCAGGAGCTTGC
CGATGCCGCTGGAAAGTCGGCAAACCGACCGTCGACTTCCCGGTGTTCCCTGACTACGGCGA
AGACGTGTACTACTCGGTGTCCTCGGTGGCCACCGACGAGTTGGCCGCCGCGTTGACCATCGG
CGGTAAAGCCGAGCGCGACCAGCGCATCGACGAAATCAAGACCCAGGTTGTGCAGCGGCTCGC
CGACACCTACGAGGGTCGCGAAAAGGAGGTCGGCGCCGCGTTGCGTGCCCTGACCAAAAAGCT
GGTTCGGCAGCGCATCCTCACCGACCATTTCCGTATCGACGGCCGCGGCATCACCGACATTCG
CGCATTGTCGGCCGAGGTGGCCGTGGTTCCGCGCGCGCACGGCAGCGCGCTGTTCGAACGCG
GCGAAACCCAGATCCTGGGTGTGACCACACTCGACATGATCAAGATGGCCCAGCAGATCGACT
CGTTGGGGCCGGAGACATCGAAGCGGTACATGCACCACTACAACTTCCCGCCGTTCTCCACCG
GCGAGACCGGTCGGGTCGGTTCGCCCAAGCGGCGTGAGATCGGGCACGGCGCACTGGCCGA
GCGGGCCCTGGTGCCGGTGTTGCCGAGCGTCGAGGAATTCCCGTATGCCATTCGCCAGGTGTC
GGAGGCTCTGGGCTCCAACGGGTCGACCTCGATGGGGTCGGTGTGCGCGTCGACGCTGGCGC
TGCTCAACGCCGGGGTGCCGCTCAAGGCGCCGGTGGCCGGCATCGCGATGGGCCTGGTCTCC
GACGACATTCAAGTAGAAGGGGCGGTCGACGGCGTTGTGGAGCGTCGCTTCGTCACCCTCACC
GACATCCTCGGCGCCGAAGACGCGTTCGGTGACATGGACTTCAAGGTCGCCGGGACCAAGGAC
TTCGTCACCGCGCTGCAGCTGGACACCAAGCTCGACGGGATCCCTTCGCAGGTGCTTGCCGGA
GCACTCGAGCAGGCCAAGGACGCCCGCCTCACGATCTTGGAGGTGATGGCTGAGGCCATCGAT
AGACCCGACGAAATGAGTCCCTACGCCCCGCGGGTGACCACCATCAAGGTTCCGGTGGACAAG
ATCGGGGAGGTCATCGGACCCAAGGGCAAGGTCATCAACGCCATCACCGAGGAGACCGGCGC
GCAGATCTCCATCGAAGACGACGGCACCGTGTTCGTCGGCGCCACCGACGGGCCATCGGCACA TABLE 3-continued GGCCGCGATCGACAAGATCAACGCCATCGCCAACCCGCAGCTGCCGACGGTGGGCGAACGGT
TCCTCGGAACCGTGGTCAAGACCACCGATTTCGGTGCCTTTGTATCGTTGCTGCCTGGCCGCGA
CGGTCTGGTGCACATTTCCAAACTCGGCAAGGGCAAGCGCATCGCGAAGGTCGAGGACGTTGT
CAATGTCGGTGACAAGCTGCGGGTGGAGATCGCCGACATCGACAAACGGGGCAAGATCTCCCT
GATCCTGGTCGCCGACGAGGACAGCACCGCCGCCGCTACCGATGCCGCGACGGTCACCAGCT
GA >Rv2793c truB tRNA pseudouridine 55 synthase TB.seq 3102364:3103257 MW:31821 >emb|AL123456|MTBH37RV:c3103257–3102361, truB SEQ ID NO:107
ATGAGCGCAACCGGCCCCGGAATCGTGGTTATCGACAAGCCCGCGGGAATGACCAGCCATGAC
GTGGTGGGGCGGTGCCGCCGCATCTTCGCCACCCGGCGGGTCGGCCACGCGGGCACCCTGG
ACCCGATGGCCACCGGGGTGTTGGTGATCGGCATCGAACGCGCCACCAAGATCCTCGGTCTGC
TGACGGCGGCCCCCAAGTCGTATGCCGCCACCATCCGCTTGGGTCAGACCACTTCCACCGAGG
ACGCCGAAGGTCAAGTGCTGCAGTCGGTTCCGGCTAAGCACCTGACCATCGAGGCGATCGACG
CCGCGATGGAGCGGCTGCGCGGTGAGATCCGGCAGGTGCCGTCGTCGGTCAGCGCGATCAAG
GTCGGTGGCCGACGCGCCTATCGGTTGGCCCGCCAGGGGCGCTCCGTGCAATTGGAAGCCCG
GCCGATCCGCATCGACCGGTTCGAGCTGCTGGCCGCACGCCGGCGCGACCAGCTCATCGATAT
CGATGTGGAGATCGACTGCTCCTCGGGAACCTACATCCGCGCGTTGGCACGCGACCTCGGCGA
CGCGCTTGGGGTGGGAGGCCATGTGACGGCGTTGCGGCGCACCCGCGTCGGCCGCTTCGAGC
TGGACCAGGCGAGATCGCTCGACGATCTCGCGGAGCGCCCCGCGCTGAGCCTGAGCCTCGAT
GAGGCCTGCCTGCTGATGTTTGCGCGCCGCGACCTGACCGCCGCGGAGGCCAGCGCGGCCGC
CAACGGCCGGTCCCTGCCGGCGGTCGGTATCGACGGCGTGTACGCGGCCTGTGACGCCGACG
GCCGGGTTATCGCGCTGCTGCGTGACGAGGGTTCGCGGACCAGGTCGGTGGCGGTGCTCCGC
CCGGCGACGATGCACCCCGGGTAG >Rv2797c - TB.seq 3105619:3107304 MW:58761 >emb|AL123456|MTBH37RV:c3107304–3105616, Rv2797c SEQ ID NO:108
GTGCCACTGACCGTGGCCGATATCGATCGGTGGAACGCGCAAGCGGTCCGGGAGGTGTTTCAC
GCGGCCAGTGCCCGAGCGGAGGTGACGTTCGAGGCGTCGCGTCAGTTGGCCGCGCTGTCGAT
TTTTGCGAACTCGGGTGGCAAGACCGCTGAGGCGGCGGCACACCACAACGCGGGCATTCGCC
GAGACCTCGACGCCCACGGCAACGAGGCGTTGGCGGTTGCCCGGGCGGCCGACAGGGCCGC
CGACGGGATTGTGAAGGTTCAGTCCGAGCTGGCCGCACTACGCCATGCCGCCGCGGCCGCCG
AGCTGACGATCGATGCGCTGATCAACCGGGTGGTGCCGATCCCCGGGCTGCGATCCACCGAG
GCGCAGTGGGCGCGGACGCTGGCCAAGCAAACGGAGCTGCAGGCGGAGCTGGATGCGATTAT
GGCCGAGGCCAATGCCGTCGACGAGGAGCTGGCCTCAGCGGTCAATATGGCCGACGGTGACG
CGCCCATCCCGGCCGATTCCGGCCCGCCGGTCGGTCCCGAGGGGCTGACCCCGACCCAGCTC
GCCAGCGATGCCAACGAGGAGCGGCTGCGCGAGGAGCGCGCCCGCCTGCAGGCCCACCTCG
AGCGGTTACAGGCGGAGTATGACCAACTGAGTGTGCGGGCCGCCCGTGACTACCACAACGGCA
TCCTCGACGGTGACGCGGTGGGCCGACTGGCAGCGCTTACCGACGAGCTGAGCGCCGCCAGG
GGCCGGCTGGGTGAGCTCGATGCCGTCGACGAGGCGTTGAGCCGAGCACCCGAGACCTACCT
GACCCAGCTGCAGATTCCCGAGGACCCAAATCAGCAGGTGCTGGCGGCCGTGGCCGTCGGTAA
TCCCGACACCGCCGCCAATGTGTCGGTGACGGTTCCCGGCGTCGGGTCCACCACCCGGGGCG
CCCTGCCCGGCATGGTGACCGAAGCCCGCGACCTGCGGTCGGAGGTAATCCGGCAACTCAATG
CTGCCGGCAAGCCCGCATCGGTTGCCACCATCGCCTGGATGGGCTACCACCCGCCCCCGAACC
CACTCGACACCGGCAGTGCGGGCGATCTGTGGCAGACCATGACCGATGGGCAGGCACACGCG
GGCGCGGCCGATCTGTCGCGGTATTTGCAGCAGGTGCGCGCCAATAACCCCAGTGGCCACCTG
ACCGTGTTGGGGCACTCGTATGGGTCGCTGACGGCGTCGCTGGCGTTGCAGGACCTCGATGCC
CAGAGCGCCCATCCGGTCAACGACGTCGTGTTTTACGGCTCACCCGGCTTGGAGCTGTACAGC
CCGGCGCAGCTCGGGCTCGATCACGGGCACGCTTATGTCATGCAGGCCCCCCACGACCTCATC
ACCAATCTGGTGGCGCCGTTGGCGCCGCTGCACGGATGGGGCCTGGACCCCTATCTGACCCCC
GGGTTCACGGAGCTGTCGTCACAGGCGGGTTTTGATCCGGGCGGGATCTGGCGTGACGGAGT
GTATGCCCACGGGGACTACCCGCGGTCCTTCCTCGATGCCGCCGGCCAGCCGCAGCTGCGGA
TGTCCGGCTATAACCTGGCGGCGATCGCCGCCGGGCTGCCCGACAACACGGTGGGCCCGCCG
CTGCTTCCGCCAATTCTGGGTGGCGGCATGCCGGCAGCGCCCGGCCCAGCACTGAGAGGGGG
ACGTTGA >Rv2864c ponA2 TB.seq 3175454:3177262 MW:63015 >emb|AL123456|MTBH37RV:c3177262–3175451, Rv2864c SEQ ID NO:109
ATGGTAACTAAAACAACATTAGCCTCAGCCACCTCAGGTTTGCTGCTGCTTGCGGTCGTCGCCAT
GTCGGGCTGCACCCCGCGTCCCCAAGGGCCCGGTCCGGCGGCCGAAAAGTTCTTCGCCGCGC
TGGCCATCGGTGACACCGCCTCCGCCGCCCAGCTCAGCGACAACCCCAACGAGGCGCGCGAA
GCGCTGAACGCGGCCTGGGCGGGGCTGCAGGCCGCCCACCTGGATGCGCAGGTTCTCAGCGC
CAAGTACGCCGAGGACACCGGTACGGTCGCTTATCGCTTCAGCTGGCATCTGCCCAAGGACCG
AATCTGGACCTATGACGGCCAGCTGAAGATGGCCCGCGACGAAGGGCGTTGGCACGTTCGCTG
GACCACCAGCGGGTTGCATCCCAAGCTAGGCGAACATCAAACGTTCGCGCTACGAGCCGACCC
GCCGCGGCGCGCCTCGGTGAACGAAGTCGGCGGCACCGATGTGCTGGTGCCGGGCTATCTGT
ATCACTACTCGCTGGACGCCGGCCAGGCCGGCCGCGAGCTCTTCGGCACGGCACACGCGGTG
GTGGGCGCGCTGCACCCCTTCGACGACACGCTCAATGATCCGCAGCTGCTGGCCGAACAGGCC
AGCTCGTCGACCCAGCCGTTGGACCTGGTCACGTTGCACGCCGACGACAGCAACCGGGTGGC
CGCGGCGATCGGGCAGCTGCCTGGCGTGGTGATCACACCGCAGGCCGAGCTGCTCCCGACCG
ACAAGCACTTCGCGCCGGCGGTCCTCAACGATGTCAAGAAGGCCGTCGTCGATGAACTCGACG
GCAAGGCGGGTTGGCGGGTGGTGAGCGTCAACCAAAATGGCGTCGACGTCTCGGTGCTGCAC
GAGGTCGCCCCATCACCTGCGTCGTCGGTTTCGATCACGTTGGATCGGGTCGTGCAAAACGCC
GCGCAACACGCGGTGAACACCCGGGGCGGCAAGGCGATGATCGTCGTGATCAAGCCGTCGAC
CGGCGAGATCCTGGCGATCGCGCAGAACGCCGGGGCCGATGCGGACGGTCCGGTCGCGACCA
CCGGTCTATATCCACCCGGGTCGACATTCAAGATGATCACCGCCGGTGCGGCCGTCGAGCGTG
ACCTGGCTACCCCTGAGACGCTGCTGGGTTGCCCCGGGGAGATCGACATCGGGCATCGCACCA
TTCCCAACTACGGTGGCTTTGATCTGGGCGTGGTGCCGATGTCACGCGCGTTTGCCAGTTCCTG
CAACACCACCTTCGCCGAGCTGAGCAGCAGGCTGCCTCCCCGCGGTCTGACTCAGGCGGCCC TABLE 3-continued GGCGGTACGGGATCGGGCTTGACTACCAGGTGGACGGCATCACCACGGTGACCGGTTCGGTG
CCGCCGACGGTGGACCTGGCCGAACGCACCGAGGACGGTTTCGGCCAGGGCAAGGTGCTGGC
CAGCCCGTTCGGCATGGCCTTGGTGGCGGCGACGGTAGCCGCCGGGAAGACCCCGGTTCCAC
AGCTGATCGCCGGCCGGCCGACGGCCGTCGAAGGCGATGCCACACCGATCAGCCAGAAGATG
ATCGACGCGCTGCGGCCCATGATGCGGTTGGTGGTGACCAATGGCACCGCCAAGGAGATCGCT
GGCTGTGGCGAGGTGTTCGGTAAGACCGGCGAAGCCGAATTCCCGGGCGGATCGCATTCCTG
GTTCGCCGGGTACCGTGGCGATCTGGCATTTGCGTCGCTGATCGTCGGGGGCGGTAGCTCGGA
ATACGCGGTGCGGATGACCAAGGTGATGTTCGAATCGCTGCCGCCGGGGTACCTGGCGTAG >Rv2868c gcpE TB.seq 3179368:3180528 MW:40451 >emb|AL123456|MTBH37RV:c3180528-3179365, gcpE SEQ ID NO:110
GTGACTGTAGGCTTGGGCATGCCGCAGCCCCCGGCACCCACGCTCGCTCCCCGGCGCGCCAC
CCGTCAGCTGATGGTCGGCAACGTCGGCGTGGGCAGTGACCATCCGGTCTCGGTGCAATCGAT
GTGCACCACCAAAACCCACGACGTCAACTCGACATTGCAACAAATCGCCGAGCTGACCGCGGC
CGGATGCGACATCGTGCGGGTGGCCTGCCCGCGCCAGGAGGACGCCGACGCGCTGGCCGAG
ATCGCCCGGCACAGCCAGATCCCGGTAGTCGCGGACATACATTTCCAGCCGCGCTACATATTCG
CCGCCATCGACGCTGGATGTGCCGCGGTGCGGGTCAACCCGGGCAACATCAAGGAGTTTGACG
GCCGGGTGGGTGAGGTCGCCAAGGCGGCGGGTGCGGCCGGGATCCCGATCCGAATCGGTGT
CAACGCCGGTTCGCTGGACAAACGGTTCATGGAGAAGTATGGCAAAGCCACGCCCGAGGCGCT
GGTTGAGTCGGCGCTGTGGGAGGCTTCGCTTTTCGAGGAGCATGGCTTCGGTGACATCAAGAT
CAGCGTCAAGCACAACGACCCGGTGGTGATGGTCGCCGCCTACGAGCTGCTTGCTGCACGGTG
CGACTACCCACTGCACCTCGGTGTCACCGAGGCCGGCCCTGCTTTCCAGGGCACCATCAAGTC
CGCGGTTGCCTTCGGCGCGTTGCTGTCGCGGGGCATAGGCGACACCATCCGGGTGTCGTTGTC
GGCCCCGCCGGTCGAGGAAGTCAAGGTGGGCAATCAGGTTCTCGAGTCGTTGAACCTGCGGCC
GCGTTCGCTCGAGATCGTGTCTTGCCCGTCGTGCGGTCGCGCGCAAGTCGACGTCTACACCCT
GGCCAACGAGGTAACCGCCGGCCTGGATGGTCTCGATGTGCCGTTGCGGGTGGCCGTGATGG
GGTGTGTCGTCAATGGTCCGGGTGAAGCACGTGAGGCCGACCTGGGCGTGGCGTCCGGCAAC
GGCAAAGGTCAGATCTTTGTACGGGGCGAAGTGATCAAGACCGTGCCCGAAGCACAGATCGTC
GAGACGCTGATCGAGGAGGCGATGCGGCTGGCCGCCGAAATGGGCGAGCAAGATCCGGGCGC
GACACCGAGCGGTTCGCCTATTGTGACCGTAAGCTGA >Rv2869c - TB.seq 3180548:3181759 MW:42835 >emb|AL123456|MTBH37RV:c3181759-3180545, Rv2869c SEQ ID NO:111
ATGATGTTTGTTACCGGCATTGTGCTGTTCGCGCTCGCGATCCTGATTTCGGTGGCCCTGCACG
AATGTGGTCACATGTGGGTCGCGCGCCGCACCGGGATGAAGGTACGTCGCTATTTCGTCGGCT
TTGGCCCCACGTTGTGGTCGACCCGGCGCGGCGAGACCGAATACGGTGTCAAAGCCGTTCCGC
TGGGCGGCTTCTGTGACATCGCCGGCATGACCCCGGTCGAGGAACTCGACCCCGACGAACGTG
ACCGTGCGATGTACAAGCAGGCCACCTGGAAGCGGGTCGCAGTGTTATTCGCCGGGCCCGGAA
TGAACCTCGCTATCTGCCTGGTGCTGATCTATGCCATCGCGCTGGTCTGGGGGCTGCCTAACCT
GCATCCGCCAACCAGGGCCGTAATCGGCGAAACTGGCTGCGTTGCACAGGAAGTGAGCCAGG
GCAAGCTCGAGCAGTGCACCGGGCCCGGTCCGGCGGCGCTGGCCGGAATTCGCTCCGGTGAC
GTCGTGGTCAAGGTCGGTGACACCCCGGTGTCCAGTTTCGACGAGATGGCCGCCGCGGTGCG
CAAGTCACACGGCAGCGTCCCGATCGTTGTCGAGCGTGACGGCACCGCGATTGTTACCTACGT
GGACATCGAATCCACCCAACGCTGGATCCCTAACGGGCAGGGCGGTGAGCTCCAGCCGGCAAC
GGTCGGTGCGATTGGGGTGGCGCCGCCCGGGTCGGGCCTGTGCGCTACGGCGTGTTCTCCG
CCATGCCGGCCACATTCGCGGTCACCGGCGACCTGACCGTGGAGGTGGGCAAGGCGCTGGCC
GCCCTCCCGACCAAGGTAGGTGCGCTGGTGCGGGCGATCGGCGGCGGGCAGCGTGACCCGC
AGACGCCGATAAGTGTGGTGGGCGCCAGCATCATCGGCGGCGACACCGTCGACCATGGGCTG
TGGGTGGCGTTCTGGTTCTTCTTGGCCCAGCTGAACCTCATCCTGGCTGCGATCAACCTGCTGC
CGTTGCTGCCGTTCGATGGCGGCCATATTGCCGTCGCGGTGTTCGAGAGGATCCGCAACATGG
TCCGGTCGGCTCGTGGCAAGGTGGCGGCCGCACCGGTGAATTACCTCAAACTCTTGCCGGCGA
CCTATGTGGTCTTGGTTCTTGTCGTCGGGTACATGCTCTTGACCGTCACCGCCGACCTGGTCAA
CCCGATTAGGCTTTTCCAGTAG >Rv2870c - TB.seq 3181770:3183077 MW:45324 >emb|AL123456|MTBH37RV:c3183077-3181767, Rv2870c SEQ ID NO:112
GTGGCTACCGGTGGACGCGTCGTGATCCGGCGGCGCGGTGACAACGAGGTGGTGGCGCACAA
TGATGAGGTGACCAACTCGACCGACGGGCGCGCTGACGGCCGGTTGCGGGTGGTGGTGCTGG
GCAGTACCGGCTCGATCGGCACCCAGGCGCTTCAGGTCATCGCCGACAATCCGGACCGTTTCG
AGGTAGTCGGGCTGGCCGCTGGCGGCGCCCATCTGGACACGTTGCTGCGACAACGTGCGCAG
ACCGGGGTGACCAATATTGCCGTCGCTGACGAGCACGCGGCGCAGCGGGTCGGCGACATCCC
CTACCACGGATCCGACGCCGCCACCCGGCTGGTCGAGCAGACCGAGGCCGACGTCGTCCTCA
ATGCGCTGGTCGGCGCGTTGGGCCTGCGACCGACGTTGGCCGCGCTCAAGACGGGTGCCCGG
CTGGCGCTGGCCAACAAGGAATCGCTGGTCGCCGGTGGTTCGCTGGTGCTGCGGGCGGCGCG
GCCCGGTCAGATCGTGCCGGTCGACTCCGAACACTCCGCGCTGGCCCAGTGCCTGCGCGGCG
GCACTCCCGACGAGGTCGCCAAGCTGGTGCTGACGGCCTCGGGAGGGCCGTTTCGGGGCTGG
TCCGCGGCCGACCTCGAGCATGTCACCCCCGAGCAGGCTGGCGCGCATCCTACGTGGTCGATG
GGCCCGATGAACACGCTGAATTCGGCGTCGCTGGTCAACAAGGGACTTGAGGTCATCGAAACC
CACCTGCTGTTCGGCATCCCCTACGACCGCATCGATGTCGTGGTGCACCCCCAGTCGATCATCC
ATTCGATGGTCACCTTCATCGACGGTTCGACGATCGCCCAGGCCAGTCCCCCGGACATGAAGCT
ACCGATTTCGTTAGCGCTGGGCTGGCCGCGTCGGGTCAGCGGCGCCGCTGCTGCCTGTGATTT
CCATACCGTCGAGCTGGGAGTTCGAGCCGTTGGACACCGACGTCTTCCCCGCGGTCGAGTT
GGCCCGGCAGGCCGGCGTAGCCGGTGGCTGCATGACCGCGGTTTACAATGCGGCGAACGAAG
AAGCAGCAGCGGCGTTCCTTGCTGGCCGGATCGGCTTCCCGGCCATCGTCGGCATCATCGCCG
ACGTGTTGCACGCTGCCGACCAATGGGCCGTCGAACCCGCTACCGTGGATGACGTACTCGACG
CGCAGCGCTGGGCCCGCGAGCGAGCGCAGCGCGCGGTATCTGGTATGGCTTCGGTGGCGATC
GCAAGCACGGCGAAGCCGGGCGCAGCGGGTCGACACGCATCGACGTTAGAAAGGTCCTGA >Rv2922c smc member of Smc1/Cut3/Cut14 family TB.seq 3234189:3238055 MW:139610

TABLE 3-continued

>emb|AL123456|MTBH37RV:c3238055–3234186, smc SEQ ID NO:113
GTGGGTGCAGGGAGTCGGTTTCCGCTGGTGGACCCGCTGCCGAGCGTTGGAGCTCGGCCTGA
CCGGTTACGCGGCCAACCACGCCGACGGACGCGTGCTGGTGGTCGCCCAGGGTCCGCGCGCT
GCGTGCCAGAAGCTGCTGCAGCTGCTGCAGGGCGACACGACACCGGGCCGCGTCGCCAAAGT
CGTCGCCGACTGGTCGCAGTCGACGGAGCAGATCACCGGGTTCAGCGAGCGGTAATCTGGCC
CCTCGTGTACCTCAAGAGTCTGACGTTGAAGGGCTTCAAGTCCTTCGCCGCGCCGACGACTTTA
CGCTTCGAGCCGGGCATTACGGCCGTCGTTGGGCCCAACGGCTCCGGCAAATCCAATGTGGTC
GATGCCCTGGCGTGGGTGATGGGGGAGCAGGGGGCAAAGACGCTGCGCGGCGGCAAGATGG
AAGACGTCATCTTCGCCGGCACCTCGTCGCGTGCGCCGCTGGGCCGCGCCGAAGTCACCGTTA
GCATCGACAACTCCGACAACGCACTGCCTATCGAATACACCGAGGTGTCGATCACCCGAAGAAT
GTTTCGCGACGGTGCCAGCGAATACGAAATCAACGGCAGCAGTTGCCGTTTGATGGATGTGCA
GGAGTTGCTGAGCGACTCCGGCATCGGCCGTGAGATGCATGTGATTGTTGGGCAAGGGAAGCT
CGAGGAGATCTTGCAGTCGCGGCCTGAGGATCGGCGGGCGTTCATCGAGGAAGCCGCCGGTG
TGCTCAAGCATCGCAAGCGCAAGGAAAAAGCTCTGCGCAAACTCGACACGATGGCGGCGAACC
TGGCCCGGCTCACCGATCTGACCACCGAGCTCCGGCGTCAACTCAAACCGCTGGGCCGGCAG
GCCGAGGCGGCCCAGCGTGCCGCGGCCATCCAAGCCGATCTGCGCGACGCCCGGCTGCGCCT
GGCGGCCGACGACTTGGTAAGCCGCAGAGCCGAACGGGAAGCGGTCTTTCAGGCCGAGGCTG
CGATGCGCCGCGAGCATGACGAGGCCGCCGCCCGGCTGGCGGTGGCATCCGAGGAGCTGGC
CGCGCATGAGTCCGCGGTCGCCGAACTCTCGACGCGGGCCGAGTCGATCCAGCACACTTGGTT
CGGGCTGTCTGCGCTGGCCGAACGGGTGGACGCTACGGTGCGCATCGCCAGCGAACGCGCCC
ATCATCTCGATATCGAGCCGGTAGCGGTCAGCGACACCGACCCCAGAAAGCCCGAGGAGCTAG
AAGCCGAGGCCCAGCAGGTGGCCGTCGCCGAGCAACAACTGTTAGCGGAGCTGGACGCGGCG
CGTGCCCGACTCGATGCTGCCCGTGCAGAGCTGGCCGACCGGGAGCGCCGCGCCGCCGAGG
CCGACCGGGCACACCTGGCGGCGGTCCGGGAGGAGGCGGACCGCCGTGAGGGACTGGCGCG
GCTGGCTGGCCAGGTGGAGACCATGCGGGCGCGTGTCGAATCGATCGATGAGAGCGTGGCAC
GGTTGTCCGAGCGGATCGAGGATGCCGCAATGCGCGCCCAGCAGACCCGAGCCGAGTTCGAA
ACCGTGCAGGGCCGCATCGGTGAACTGGATCAAGGCGAGGTCGGCCTGGATGAGCACCACGA
GCGTACTGTGGCCGCGTTGCGGTTGGCCGACGAACGCGTCGCCGAGCTGCAATCCGCCGAAC
GCGCCGCCGAACGCCAGGTGGCATCGCTACGGGCTCGCATCGATGCGCTCGCAGTGGGGCTA
CAGCGCAAGGACGGCGCGGCGTGGCTGGCGCACAATCGCAGTGGCGCAGGGCTTTTCGGTTC
GATCGCCCAATTGGTGAAGGTACGTTCCGGCTATGAAGCGGCACTGGCCGCGGCGCTCGGGC
CGGCGGCCGACGCACTTGCGGTGGACGGCCTGACTGCCGCGGGTAGTGCCGTCAGCGCACTC
AAACAAGCCGACGGCGGTCGCGCGGTCCTCGTGCTGAGTGACTGGCCGGCCCCGCAAGCCCC
CCAATCCGCCTCGGGGGAGATGCTGCCTAGCGGCGCCCAGTGGGCCCTAGACCTGGTCGAGT
CTCCACCGCAGTTGGTTGGCGCGATGATCGCCATGCTTTCGGGTGTCGCGGTGGTCAACGACC
TGACTGAGGCAATGGGCCTGGTCGAGATTCGTCCGGAGCTACGCGCGGTCACCGTTGACGGTG
ATCTGGTGGGCGCCGGCTGGGTCAGCGGCGGATCGGACCGCAAGCTGTCCACCTTGGAGGTC
ACCTCCGAGATCGACAAGGCCAGGAGTGAGCTGGCCGCTGCCGAGGCGCTGGCGGCGCAATT
GAATGCGGCCCTGGCCGGTGCGCTGACCGAGCAGTCCGCCCGCCAGGACGCGGCCGAGCAA
GCCTTGGCCGCGCTTAACGAATCCGACACGGCCATCTCGGCGATGTACGAGCAGCTGGGCCGC
CTCGGGCAGGAGGCCCGCGCGGCGGAAGAAGAGTGGAACCGGTTGCTGCAGCAGCGTACGGA
ACAGGAAGCCGTGCGCACACAGACTCTCGACGACGTCATACAACTTGAGACCCAGCTGCGTAA
GGCCCAGGAGACCCAACGGGTGCAGGTGGCCCAACCGATCGACCGCCAGGCGATCAGTGCCG
CTGCCGATCGCGCCCGCGGTGTCGAAGTGGAAGCCCGGCTGGCGGTGCGCACCGCCGAGGAA
CGCGCCAACGCGGTTCGCGGGCGGGCCGATTCGCTGCGCCGTGCGGCTGCGGCGGAACGTG
AGGCGCGGGTGCGGGCTCAGCAAGCACGCGCCGCAAGACTGCATGCGGCCGCGGTGGCCGC
AGCGGTCGCCGACTGCGGACGGCTGCTGGCCGGGCGGTTGCACCGGGCGGTGGACGGGGCG
TCGCAACTGCGCGACGCGTCGGCCGCGCAACGTCAGCAGCGGTTAGCGGCGATGGCCGCGGT
GCGCGACGAGGTGAACACGCTGAGCGCCCGAGTGGGGGAACTCACCGATTCGCTGCACCGCG
ACGAGCTGGCTAACGCGCAGGCGGCGCTGCGTATCGAGCAGCTTGAGCAGATGGTGCTAGAG
CAGTTCGGAATGGCGCCGGCCGACTTGATCACCGAATACGGTCCACATGTGGCGCTACCACCG
ACCGAGCTCGAGATGGCTGAGTTCGAGCAAGCCCGCGAACGCGGCGAGCAGGTGATTGCGCC
CGCCCCCATGCCGTTCGACCGGGTTACCCAGGAGCGCCGGGCCAAACGCGCCGAGCGTGCGC
TTGCCGAGTTGGGCAGGGTCAACCCGCTGGCGCTCGAAGAGTTTGCTGCCTTGGAGGAGCGCT
ACAATTTCCTGTCCACCCAACTCGAGGATGTCAAGGCTGCCCGCAAGGATCTGCTGGGCGTCGT
CGCCGATGTTGACGCCCGCATCCTGCAGGTGTTCAATGACGCGTTCGTAGACGTGGAACGCGA
ATTTCGCGGCGTGTTCACCGCATTGTTCCCCGGTGGTGAAGGACGGCTGCGGCTGACCGAGCC
CGACGACATGCTCACCACCGGCATCGAGGTCGAAGCCCGCCCGCCGGGCAAGAAGATTACCC
GACTGTCTTTGCTCTCCGGTGGCGAGAAGGCGCTGACCGCGGTGGCGATGCTGGTCGCGATCT
TTCGTGCCCGTCCATCGCCGTTCTACATCATGGACGAGGTGGAGGCCGCCCTCGACGACGTGA
ACCTGCGCCGACTGCTCAGCCTGTTCGAACAGCTGCGAGAGCAGTCGCAGATCATCATCATCAC
CCACCAGAAGCCGACGATGGAGGTCGCGGACGCACTGTACGGCGTAACCATGCAGAACGACG
GCATCACCGCGGTCATCTCGCAGCGCATGCGCGGTCAGCAGGTGGATCAGCTGGTTACCAATT
CCTCGTAG >Rv2925c rnc RNAse III TB.seq 3239829:3240548 MW:25400
>emb|AL123456|MTBH37RV:c3240548–3239826, mc SEQ ID NO:114
ATGATCCGGTCACGACAACCCCTGCTCGACGCACTCGGTGTGGACCTCCCGGACGAGCTGCTC
TCACTGGCGTTGACCCACCGCAGCTACGCCTACGAGAACGGCGGGCTGCCGACCAACGAGCGT
TTGGAGTTTCTCGGCGATGCCGTGCTAGGGCTGACCATCACCGACGCGCTGTTCCATCGTCATC
CTGATCGGTCGGAGGGGGATCTGGCCAAACTGCGGGCCAGCGTAGTCAACACCCAGGCCCTG
GCCGACGTCGCACGCCGCCTCTGTGCGGAAGGCCTCGGTGTTCACGTGCTATTGGGTCGCGGC
GAGGCGAACACCGGCGGGGCCGACAAGTCCAGCATTCTGGCCGACGGTATGGAATCGCTGCT
GGGCGCGATCTACCTGCAACACGGTATGGAGAAGGCCCGTGAGGTGATCCTGCGGCTGTTTGG
CCCGTTGCTGGACGCCGCGCCGACCCTGGGTGCGGGATTGGATTGGAAGACCAGCTTGCAGG
AGCTGACTGCAGCGCGAGGGCTGGGTGCGCCGTCATACCTGGTCACCTCCACCGGCCCGGAC
CACGATAAGGAATTCACCGCGGTGGTTGTCGTGATGGACAGCGAATACGGTTCAGGAGTGGGC
CGGTCCAAAAAAGAAGCCGAGCAAAAAGCCGCGGCGGCCGCTTGGAAAGCCCTGGAAGTGCTC
GACAACGCCATGCCGGGCAAAACCTCCGCCTAA TABLE 3-continued >Rv2934 ppsD TB.seq 3262245:3267725 MW:193317
>emb|AL123456|MTBH37RV:3262245–3267728, ppsD SEQ ID NO:115
ATGACAAGTCTGGCGGAGCGCGCGGCGCAACTGTCGCCGAACGCGCGAGCGGCCCTGGCGCG
CGAGCTCGTCCGTGCGGGTACGACCTTCCCGACCGACATCTGCGAGCCGGTGGCGGTGGTGG
GCATCGGCTGTCGCTTTCCGGGGAATGTGACTGGGCCAGAGAGCTTTTGGCAGCTACTGGCCG
ACGGTGTGGACACAATCGAGCAGGTGCCGCCTGATCGGTGGGATGCGGACGCGTTCTACGATC
CCGATCCTTCGGCGTCGGGTCGGATGACGACGAAATGGGGTGGTTTCGTTTCCGATGTCGACG
CGTTCGACGCCGACTTTTTCGGAATCACTCCTCGGGAAGCCGTGGCGATGGACCCGCAGCATC
GGATGCTGCTCGAGGTTGCCTGGGAAGCGTTGGAGCACGCGGGTATTCCGCCGGATTCCTTGA
GCGGCACTCGAACCGGCGTGATGATGGGTCTGTCGTCGTGGGACTACACGATCGTCAATATCG
AGCGCAGAGCCGACATCGACGCGTACCTGAGCACCGGAACCCCGCACTGTGCCGCGGTGGGG
CGGATCGCGTATCTGTTGGGATTGCGTGGTCCGGCCGTCGCCGTAGATACCGCTTGTTCGTCGT
CGCTGGTGGCAATTCACTTGGCGTGTCAGAGCCTTCGCCTGCGTGAAACCGACGTGGCATTGG
CGGGCGGGGTGCAGCTCACCTTGTCACCGTTCACCGCCATCGCGCTGTCCAAGTGGTCGGCGC
TGTCACCGACCGGCCGATGCAACAGCTTCGACGCCAACGCGGATGGATTCGTGCGCGGCGAG
GGCTGCGGCGTGGTGGTGCTCAAGCGGTTGGCCGACGCGGTGCGCGACCAGGACCGGGTGCT
TGCGGTGGTCCGCGGTTCGGCAACTAACTCCGATGGTCGGTCCAACGGCATGACCGCACCGAA
CGCGCTGGCGCAGCGTGACGTGATCACATCCGCCCTCAAGCTTGCGGATGTTACCCCTGACAG
CGTGAACTATGTCGAAACACACGGCACCGGAACGGTGTTGGGGGACCCCATCGAGTTCGAGTC
GCTGGCGGCCACTTATGGCCTGGGTAAAGGCCAGGGCGAGAGCCCGTGCGCATTGGGGTCGG
TCAAGACCAACATCGGCCACCTGGAGGCGGCCGCCGGTGTGGCTGGATTCATCAAGGCGGTGC
TGGCGGTGCAACGTGGGCACATTCCCCGCAACTTGCACTTCACCCGGTGGAACCCGGCCATCG
ACGCGTCGGCGACGCGGCTGTTCGTGCCGACCGAAAGCGCCCCGTGGCCGGCGGCTGCCGGT
CCACGCAGGGCTGCGGTGTCATCGTTCGGCCTCAGCGGGACCAACGCGCACGTGGTGGTCGA
GCAGGCACCCGACACCGCAGTAGCCGCAGCCGGCGGCATGCCGTATGTTTCGGCGCTGAACG
TCTCCGGCAAGACGGCCGCGCGGGTGGCGTCGGCGGCGGCGGTGCTGGCCGACTGGATGTC
GGGGCCGGGCGCGGCGGCACCACTGGCCGACGTGGCACACACGTTGAACCGGCACCGGGCC
CGGCACGCCAAGTTCGCCACCGTCATCGCGCGTGACCGCGCCGAGGCGATCGCGGGGTTGCG
AGCGCTGGCGGCCGGACAACCACGCGTTGGGGTGGTGGATTGCGACCAGCATGCCGGTGGGC
CTGGCCGGGTTTTTGTGTATTCGGGTCAGGGCTCGCAGTGGGCGTCGATGGGCCAGCAGTTGC
TGGCCAACGAACCGGCGTTCGCCAAGGCGGTAGCCGAGCTGGATCCGATATTCGTTGACCAGG
TTGGCTTTTCGCTGCAGCAAACGCTTATCGACGGCGACGAGGTGGTGGGCATCGACCGCATCC
AGCCGGTGCTGGTCGGGATGCAGTTGGCGCTGACCGAGTTATGGCGGTCCTATGGGGTGATTC
CAGATGCCGTGATCGGGCACTCGATGGGTGAGGTGTCGGCGGCAGTGGTGGCCGGCGCGTTG
ACGCCCGAGCAGGGCTTGCGGGTCATCACCACCCGGTCGCGGTTGATGGCGCGGCTGTCGGG
GCAGGGAGCGATGGCGCTGCTCGAGCTGGATGCCGACGCCGCCGAGGCGCTGATTGCCGGCT
ATCCGCAGGTGACGCTGGCGGTGCATGCGTCACCGCGCCAGACGGTGATCGCCGGGCCGCCC
GAGCAGGTGGACACGGTGATCGCGGCGGTAGCGACGCAAAACCGGTTGGCGCGCCGCGTCGA
AGTCGACGTGGCCTCCCATCACCCGATCATCGATCCCATACTGCCCGAGTTGCGAAGCGCGTTA
GCGGATTTGACTCCGCAGCCGCCGAGCATCCCGATCATTTCCACTACGTACGAAAGCGCGCAG
CCGGTGGCGGATGCCGACTATTGGTCGGCCAACCTGCGCAACCCGGTGCGATTCCACCAGGCC
GTCACCGCCGCCGGTGTCGACCACAACACCTTCATCGAAATCAGCCCTCACCCCGTGCTCACG
CACGCACTCACCGACACCCTGGATCCGGACGGCAGCCATACAGTCATGTCGACGATGAACCGC
GAACTGGACCAGACGCTGTATTTCCACGCCCAACTCGCCGCGGTCGGTGTGGCTGCGTCCGAG
CACACCACCGGTCGCCTTGTCGACCTGCCCCCCACACCGTGGCACCATCAGCGATTCTGGGTC
ACGGATCGTTCGGCGATGTCCGAGCTGGCCGCGACCCACCCGCTCCTGGGCGCGCACATCGA
GATGCCGCGCAACGGAGACCATGTCTGGCAGACCGATGTCGGCACCGAGGTCTGTCCCTGGTT
GGCAGACCACAAGGTGTTCGGTCAACCCATCATGCCGGCCGCGGGGTTCGCCGAGATCGCCTT
GGCGGCGGCCAGCGAAGCCCTCGGCACAGCCGCCGACGCCGTCGCACCCAACATCGTGATCA
ACCAGTTCGAGGTGGAGCAGATGCTGCCCCTCGACGGCCACACGCCGCTAACGACGCAGTTAA
TTCGCGGCGGGGACAGCCAGATTCGGGTCGAGATCTATTCCCGCACGCGTGGCGGAGAGTTCT
GCCGACACGCCACGGCCAAGGTTGAACAATCGCCGCGCGAATGTGCGCACGCGCACCCGGAA
GCCCAAGGTCCCGCCACCGGGACAACAGTGTCGCCGGCCGATTTTTATGCCCTGCTCCGCCAA
ACCGGCCAACACCATGGTCCGGCGTTCGCGGCCTTAAGCCGGATCGTGCGCCTGGCCGATGGT
TCCGCGGAAACCGAGATCAGCATTCCCGACGAGGCGCCGCGCCATCCCGGGTATCGGCTGCA
CCCCGTGGTATTGGATGCGGCATTGCAAAGCGTGGGTGCCGCGATACCCGACGGCGAGATCGC
GGGGTCGGCGGAAGCCAGCTATCTGCCAGTGTCGTTCGAGACCATCCGGGTGTACCGCGACAT
CGGTCGGCACGTCAGGTGTCGTGCCCACCTGACAAACCTCGACGGCGGCACCGGAAAGATGG
GCAGGATCGTCCTAATCAACGACGCCGGCCACATAGCGGCCGAAGTGGACGGCATCTATCTGC
GTCGTGTCGAACGCCGTGCGGTACCCCTGCCACTAGAGCAGAAGATCTTCGATGCCGAATGGA
CCGAAAGCCCGATCGCAGCCGTGCCGGCTCCGGAGCCAGCTGCCGAGACGACGCGGGGAAGT
TGGCTGGTACTCGCCGATGCAACGGTGGATGCGCCAGGCAAGGCCCAGGCCAAGTCGATGGC
CGACGACTTCGTGCAGCAGTGGCGCTCACCGATGCGGCGGGTGCACACCGCCGATATCCACGA
CGAATCGGCGGTGCTGGCCGCATTTGCAGAAACGGCAGGCGATCCCGAGCACCCGCCGGTTG
GCGTGGTGGTGTTCGTCGGCGGTGCCTCGAGTCGACTGGACGACGAGCTGGCGGCGGCGCGC
GACACGGTGTGGTCGATCACCACGGTGGTTCGTGCGGTCGTCGGCACGTGGCACGGCCGATCA
CCGCGGCTATGGCTGGTCACCGGGGGCGGACTTTCCGTTGCCGACGACGAGCCGGGAACACC
CGCGGCGGCTTCCTTGAAAGGGCTGGTGCGGGTGCTCGCCTTCGAGCACCCGGACATGCGCA
CCACCCTGGTCGATCTGGACATCACACAAGACCCGCTGACCGCGCTGAGCGCGGAACTGCGGA
ATGCCGGGAGTGGGTCGCGCCATGATGACGTGATCGCGTGGCGCGGCGAGCGCAGGTTCGTC
GAACGGCTGTCGCGCGCCACGATCGATGTATCCAAAGGGCATCCGGTGGTGCGCCAGGGAGC
GTCGTACGTCGTCACCGGCGGCCTCGGCGGTCTCGGCCTGGTCGTCGCTCGTTGGCTGGTGG
ACCGCGGCGCCGGCCGGGTGGTGCTGGGTGGCCGCAGCGATCCCACTGACGAGCAGTGCAAC
GTCCTGGCCGAACTGCAGACCCGCGCCGAGATCGTGGTTGTCCGTGGCGACGTGGCATCGCC
GGGGGTGGCAGAAAAGCTGATTGAGACGGCCCGACAGTCTGGGGGCCAATTGCGCGGCGTCG
TGCACGCCGCCGCGGTCATCGAAGACAGCCTGGTGTTCTCTATGAGCAGGGACAACCTAGAAC
GGGTGTGGGCACCCAAGGCCACCGGTGCGCTGCGCATGCACGAAGCCACCGCTGACTGCGAG
CTCGACTGGTGGCTCGGATTCTCTTCCGCCGCTTCGCTATTGGGTTCTCCCGGGCAAGCGGCCT TABLE 3-continued

```
ACGCGTGCGCCAGCGCGTGGCTGGACGCGCTGGTCGGATGGCGCAGGGCATCCGGCCTGCC
GGCCGCGGTGATCAACTGGGGTCCGTGGTCGGAGGTAGGCGTCGCCCAGGCCTTGGTGGGCA
GTGTTCTCGACACGATCAGTGTCGCAGAAGGCATCGAGGCTCTCGACTCATTGCTTGCCGCCGA
CCGGATCCGCACTGGAGTGGCTCGGCTGCGTGCCGATCGGGCCCTGGTCGCATTCCCGGAGA
TCCGCAGCATCAGCTACTTCACCCAGGTGGTCGAGGAGCTGGACTCGGCGGGTGACCTCGGCG
ACTGGGGCGGGCCCGACGCGCTTGCCGACCTCGACCCGGGCGAGGCGCGGCGCGCGGTGAC
CGAGCGGATGTGTGCGCGCATCGCTGCGGTGATGGGCTACACTGACCAGTCGACTGTCGAACC
CGCCGTGCCCTTGGACAAGCCCCTGACCGAGCTGGGGCTGGATTCTCTGATGGCGGTACGAAT
ACGCAACGGCGCGCGGGCGGATTTCGGCGTGGAACCGCCGGTAGCGCTGATACTGCAAGGCG
CGTCCTTGCATGACCTGACGGCGGACTTAATGCGCCAACTCGGGCTCAATGATCCCGATCCGG
CGCTCAACAACGCTGACACTATTCGCGACCGGGCGCGCCAGCGCGCGGCAGCGCGACACGGA
GCCGCGATGCGGCGCCGACCTAAACCTGAAGTACAGGGAGGATAA

>Rv2946c pks1 TB.seq 3291503:3296350 MW:166642
>emb|AL123456|MTBH37RV:c3296350—3291500, pks1 SEQ ID NO:116
GTGATTTCGGCGAGATCGGCTGAGGCGTTGACGGCGCAGGCGGGTCGACTTATGGCCCACGTG
CAGGCCAACCCAGGGCTGGATCCGATCGATGTGGGGTGCTCGTTGGCCAGTCGCTCGGTGTTT
GAGCACCGAGCGGTGGTGGTCGGCGCAAGCCGTGAGCAACTGATTGCCGGGCTGGCTGGGCT
CGCGGCGGGCGAGCCGGGTGCCGGCGTGGCGGTCGGTCAGCCAGGGTCGGTGGGCAAGACG
GTGGTCGTGTTTCCTGGGCAGGGCGCGCAGCGCATCGGGATGGGCCGCGAGTTGTACGGCGA
GTTGCCCGTGTTTGCGCAGGCATTCGATGCGGTGGCCGACGAGTTGGACCGGCATCTGCGGTT
GCCGCTGCGCGACGTTATTTGGGGTGCCGATGCGGATTTGCTTGACAGCACCGAATTTGCTCAG
CCCGCGTTGTTCGCGGTGGAGGTGGCATCGTTCGCGGTGTTGCGGGATTGGGGTGTGCTTCCG
GACTTCGTCATGGGTCACTCCGTTGGAGAGCTGGCGGCGGCGCACGCGGCCGGTGTGTTGAC
GTTGGCGGACGCGGCGATGCTGGTGGTGGCGCGGGGCCGGTTGATGCAGGCGCTGCCGGCA
GGCGGTGCGATGGTGGCGGTGGCTGCCAGTGAGGACGAGGTGGAGCCGCTGCTGGGTGAGG
GTGTGGGGATCGCTGCGATCAACGCGCCCGAATCGGTGGTGATCTCCGGTGCGCAGGCCGCG
GCAAATGCGATTGCGGATCGGTTCGCCGCGCAGGGTCGGCGGGTGCACCAGTTGGCGGTCTC
GCATGCGTTTCATTCGCCGTTGATGGAGCCGATGCTCGAGGAGTTCGCGCGTGTCGCGGCCCG
GGTGCAGGCACGCGAGCCCCAGCTTGGGCTGGTGTCGAACGTGACGGGCGAGTTGGCCGGCC
CTGATTTCGGGTCGGCGCAGTACTGGGTGGACCACGTTCGTCGGCCGGTGCGCTTCGCGGACA
GTGCGCGTCATTTGCAGACCCTTGGGGCGACCCACTTCATCGAGGCCGGCCCGGGAAGTGGTT
TGACTGGCTCGATCGAGCAGTCCTTGGCCCCGGCTGAGGCGATGGTGGTGTCGATGCTGGGCA
AAGACCGGCCCGAGCTGGCCTCGGCGCTCGGTGCTGCCGGTCAGGTGTTCACCACCGGTGTG
CCGGTGCAGTGGTCGGCGGTGTTCGCCGGCTCGGGTGGACGGCGGGTGCAGCTGCCCACGTA
TGCGTTTCAGCGACGGCGGTTTTGGGAGACGCCGGGCGCGGATGGGCCCGCCGATGCGGCCG
GGTTGGGTCTGGGCGCGACCGAGCATGCCTTGTTGGGTGCGGTGGTCGAGCGGCCCGATTCT
GACGAGGTGGTGCTGACCGGCCGGTTGTCGCTTGCGGATCAGCCGTGGCTGGCCGACCACGT
GGTGAACGGGGTGGTGCTGTTCCCCGGGGCGGGTTTTGTGGAGTTGGTGATCCGCGCCGGTG
ATGAGGTCGGGTGCGCGCTCATCGAAGAGTTGGTGCTGGCCGCACCGTTGGTGATGCACCCGG
GTGTCGGGGTTCAGGTGCAGGTGGTCGTCGGGGCTGCCGATGAATCCGGGCACCGTGCGGTG
TCGGTGTATTCCCGCGGTGATCAATCCCAGGGTTGGTTGCTGAACGCCGAAGGCATGCTGGGG
GTGGCTGCCGCTGAGACGCCGATGGATTTGTCCGTGTGGCCGCCCGAGGGCGCGGAGAGTGT
GGATATCTCGGACGGCTATGCGCAGTTGGCCGAGCGCGGTTATGCCTACGGCCCCGCGTTTCA
GGGTCTGGTGGCGATCTGGCGGCGGGGGTCGGAGCTGTTCGCCGAAGTTGTAGCCCCCGGCG
AGGCCGGCGTGGCCGTCGACCGAATGGGGATGCATCCGGCGGTGTTGGACGCGGTGCTGCAT
GCCCTCGGGCTGGCCGTCGAGAAGACCCAGGCGAGCACCGAGACGAGACTGCCGTTTTGCTG
GCGTGGGGTGTCGCTGCATGCCGGCGGCGCTGGACGGGTGCGGGCCCGCTTCGCGTCCGCG
GGCGCGGATGCGATTTCCGTGGACGTCTGCGACGCCACTGGGCTGCCGGTGTTGACGGTGCG
CTCGCTGGTTACTCGCCCGATAACCGCAGAACAGCTGCGCGCCGCCGTGACCGCGGCCGGCG
GTGCGTCCGATCAGGGGCCGCTGGAAGTGGTGTGGTCGCCGATCTCGGTGGTCAGCGGCGGC
GCTAACGGGTCCGCCCCACCTGCCCCGGTGTCTTGGGCGGACTTTTGCGCCGGCAGTGATGGT
GACGCCAGTGTCGTGGTGTGGGAACTCGAGTCTGCCGGTGGCCAAGCATCCTCGGTGGTGGG
CTCGGTGTATGCGGCCACCCACACCGCCCTGGAGGTGTTGCAGTCCTGGCTCGGCGCGGATCG
GGCGGCCACGTTGGTGGTGTTGACCCATGGTGGCGTGGGGCTGGCTGGCGAGGACATCAGCG
ACCTGGCCGCCGCCGCGGTGTGGGGCATGGCGCGTTCCGCGCAGGCCGAAAATCCCGGCCG
GATCGTGTTGATCGACACCGATGCGGCGGTGGATGCCTCGGTGCTAGCCGGCGTCGGGGAAC
CCCAGCTGCTGGTGCGCGGCGGCACTGTGCACGCCCCCGGCTGTCCCCGGCCCCGGCGTTG
CTAGCGTTACCGGCGGCAGAGTCGGCGTGGCGATTGGCCGCCGGTGGTGGCGGGACCCTGGA
GGATTTGGTGATCCAGCCCTGCCCGGAGGTACAGGCACCGCTACAGGCGGGGCAGGTGCGCG
TGGCGGTGGCGGCCGTCGGGGTCAACTTCCGCGATGTGGTGGCCGCCCTAGGGATGTATCCC
GGCCAGGCCCCACCGCTGGGTGCCGAAGGCGCCGGGGTGGTGCTTGAGACCGGTCCCGAAGT
GACCGATCTTGCCGTCGGTGACGCCGTGATGGGATTCCTGGGCGGGGCCGGTCCGCTGGCGG
TGGTGGATCAGCAACTGGTTACCCGGGTGCCGCAAGGCTGGTCGTTTGCTCAGGCAGCCGCTG
TGCCGGTGGTGTTCTTGACGGCCTGGTACGGGTTGGCCGATTTAGCCGAGATCAAGGCGGGCG
AATCGGTGCTGATCCATGCCGGTACCGGCGGTGTGGGCATGGCGGCTGTGCAGCTGGCTCGC
CAGTGGGGCGTGGAGGTTTTCGTCACCGCCAGCCGTGGCAAGTGGGACACGCTGCGCGCCAT
GGGGTTTGACGACGACCATATCGGCGATTCCCGCACATGCGAGTTCGAGGAGAAGTTCCTGGC
GGTCACCGAGGGCCGCGGGGTTGATGTGGTGCTCGACTCGCTGGCCGGTGAGTTCGTGGATG
CGTCGCTGCGCTTACTGGTCCGCGGTGGGCGTTTCCTCGAGATGGGCAAGACGGATATCCGCG
ATGCGCAGGAGATCGCCGCTAATTATCCCGGCGTGCAGTATCGGGCGTTCGACCTGTCGGAGG
CCGGCCCGGCACGCATGCAGGAGATGTTGGCCGAGGTGCGGGAGCTGTTCGACACCCGGGAG
CTGCACCGGCTACCGGTCACCACGTGGGATGTGCGCTGCGCCCCGGCGGCCTTCCGGTTCATG
AGCCAGGCCCGCCATATCGGCAAGGTTGTCTTAACCATGCCCTCGGCGTTGGCCGACCGGCTT
GCCGACGGCACGGTGGTGATCACCGGTGCCACCGGGGCGGTTGGTGGGGTGTTGGCCCGCCA
CCTGGTTGGCGCCTATGGGGTGCGTCATCTGGTGTTGGCCAGTCGGCGGGGCGATCGCGCGG
AGGGAGCGGCCGAATTGGCCGCCGACTTGACGGAGGCCGGCGCCAAGGTGCAGGTGGTGGC
CTGTGACGTGGCCGATCGCGCTGCGGTAGCGGGGTTGTTTGCCCAGCTGTCGCGGGAGTACCC
GCCGGTGCGCGGGGTGATTCATGCCGCCGGCGTGCTCGATGACGCAGTGATCACCTCGTTGAC
```

TABLE 3-continued

```
ACCGGACCGCATCGATACGGTGTTGCGGGCCAAGGTGGACGCGGCGTGGAACCTGCACCAGG
CCACCAGTGACCTGGATTTGTCGATGTTTGCGCTGTGCTCATCGATCGCGGCCACGGTCGGCTC
GCCGGGGCAGGGCAACTACTCGGCGGCAAACGCGTTTCTGGACGGGTTGGCCGCTCACCGGC
AGGCCGCAGGGTTGGCCGGGATATCACTGGCGTGGGGTTTGTGGGAACAGCCTGGCGGCATG
ACCGCGCATTTGAGCAGCCGAGATCTGGCCCGCATGAGCCGCAGCGGGCTGGCTCCGATGAG
CCCTGCCGAAGCGGTGGAATTGTTTGACGCTGCGCTGGCCATCGATCACCCTCTGGCGGTGGC
CACGCTCTTGGACCGGGCTGCACTAGACGCCCGGGCCCAGGCCGGTGCGTTGCCGGCGCTGT
TCAGCGGGCTCGCGCGCCGCCCACGCCGACGCCAAATCGACGACACCGGTGACGCCACCTCG
TCGAAGTCGGCGCTGGCTCAACGCCTACACGGGCTGGCCGCGGACGAACAACTCGAGCTGCTA
GTGGGGCTGGTGTGTCTGCAGGCAGCGGCAGTGCTGGGTAGGCCCTCCGCCGAGGACGTCGA
CCCCGACACCGAATTCGGCGACCTCGGTTTCGACTCATTAACGGCTGTGGAGTTACGCAACCGC
CTCAAAACCGCCACCGGACTGACGCTGCCACCTACCGTGATTTTCGATCATCCCACTCCCACTG
CGGTCGCCGAGTATGTCGCCCAGCAAATGTCTGGCAGCCGCCCAACGGAATCCGGTGATCCGA
CGTCGCAGGTTGTCGAACCCGCCGCCGCGGAAGTATCGGTCCATGCCTAG

>Rv3014c ligA DNA ligase TB.seq 3372545:3374617 MW:75258
>emb|AL123456|MTBH37RV:c3374617-3372542, ligA SEQ ID NO:117
GTGAGCTCCCCAGACGCCGATCAGACCGCTCCCGAGGTGTTGCGGCAGTGGCAGGCACTGGC
CGAGGAGGTGCGTGAGCACCAGTTCCGTTATTACGTGCGGGACGCGCCGATCATCAGCGACGC
GGAATTCGACGAGCTGCTGCGCCGTCTGGAAGCCCTCGAGGAGCAGCATCCCGAGCTGCGCA
CGCCCGATTCGCCGACCCAGCTGGTCGGCGGTGCCGGCTTCGCCACGGATTTCGAGCCCGTC
GACCATCTCGAACGAATGCTCAGCCTCGACAACGCGTTCACCGCCGACGAACTCGCCGCCTGG
GCCGGCCGCATCCATGCCGAGGTCGGAGACGCCGCACATTACCTGTGTGAGCTCAAGATCGAC
GGCGTCGCGCTGTCTTTGGTCTACCGCGAGGGACGGCTGACCCGGGCCTCCACCCGCGGCGA
CGGGCGCACCGGCGAGGACGTCACCCTGAACGCCCGGACCATCGCCGACGTTCCCGAACGGC
TCACCCCCGGCGACGACTACCCGGTGCCCGAGGTCCTCGAGGTCCGCGGCGAGGTCTTCTTCC
GGCTGGACGACTTCCAGGCGCTCAACGCCAGCCTCGTCGAGGAGGGCAAGGCGCCGTTCGCC
AACCCCCGCAACAGCGCGGCGGGATCGCTGCGCCAGAAAGACCCGGCGGTCACCGCGCGCCG
CCGGCTGCGGATGATCTGCCACGGGCTGGGCCACGTGGAGGGCTTTCGCCCGGCCACCCTGC
ATCAGGCATACCTGGCGTTGCGGGCATGGGGACTGCCGGTTTCCGAACACACCACCCTGGCAA
CCGACCTGGCCGGTGTGCGCGAGCGCATCGACTACTGGGGCGAGCACCGCCACGAGGTGGAC
CACGAAATCGACGGCGTGGTGGTCAAAGTCGACGAGGTGGCGTTGCAGCGCAGGCTGGGTTC
CACGTCGCGGGCGCCGCGCTGGGCCATCGCCTACAAGTACCCGCCCGAGGAAGCGCAGACCA
AGCTGCTCGACATCCGGGTGAACGTCGGCCGCACCGGGCGGATCACGCCGTTTGCGTTCATGA
CGCCGGTGAAGGTGGCCGGGTCGACGGTGGGACAGGCCACCCTGCACAACGCCTCGGAGATC
AAGCGCAAGGGCGTGCTGATCGGCGACACCGTGGTGATCCGCAAGGCCGGCGACGTGATCCC
CGAGGTGCTGGGACCCGTCGTCGAACTGCGCGATGGCTCCGAACGCGAATTCATCATGCCCAC
CACCTGCCCGGAGTGCGGTTCGCCGTTGGCGCCGGAGAAGGAAGGCGACGCCGACATCCGTT
GCCCCAACGCCCGCGGCTGCCCGGGGCAACTGCGGGAGCGGGTTTTCCACGTCGCCAGCCGC
AACGGCCTAGACATCGAGGTGCTCGGTTACGAGGCGGGTGTGGCGCTCTTGCAGGCGAAGGT
GATCGCCGACGAGGGCGAGCTGTTCGCGCTGACCGAGCGGGACTTGCTGCGCACCGACCTGT
TCCGAACCAAGGCAGGCGAACTGTCGGCCAACGGCAAACGGCTGCTGGTCAACCTCGACAAGG
CCAAGGCGGCACCGCTGTGGCGGGTGCTGGTGGCGCTGTCCATCCGCCATGTCGGGCCGACG
GCGGCCCGCGCCCTGGCCACCGAGTTCGGCAGCCTTGACGCCATCGCCGCGGCGTCCACCGA
CCAGCTGGCCGCCGTCGAGGGGGTGGGGCCGACCATTGCCGCCGCGGTCACCGAGTGGTTCG
CCGTCGACTGGCACCGCGAGATCGTCGACAAGTGGCGGGCCGCCGGGGTGCGAATGGTCGAC
GAGCGTGACGAGAGTGTGCCACGCACGCTGGCCGGGCTGACCATCGTGGTCACCGGCTCGCT
GACCGGTTTCTCCCGCGACGACGCCAAGGAGGCGATCGTGGCCCGCGGCGGCAAGGCCGCCG
GCTCGGTGTCGAAGAAGACCAACTATGTCGTCGCCGGAGACTCGCCGGGATCCAAATACGACA
AGGCGGTGGAGTTGGGGGTGCCGATTCTGGACGAGGATGGGTTCCGGAGACTGCTGGCCGAC
GGACCCGCGTCACGAACGTAA

>Rv3025c - NifS-like protein TB.seq 3383885:3385063 MW:40948
>emb|AL123456|MTBH37RV:c3385063-3383882, Rv3025c SEQ ID NO:118
ATGGCCTACCTGGATCACGCTGCCACCACCCCGATGCACCCCGCCGCCATCGAGGCGATGGCG
GCCGTGCAGCGCACCATCGGCAATGCGTCGTCGCTGCACACCAGCGGGCGCTCGGCGCGCCG
GCGGATCGAGGAGGCCCGTGAGCTGATCGCGGACAAGCTAGGCGCTCGTCCGTCCGAGGTGA
TCTTCACCGCGGGCGGCACCGAAAGCGACAACCTGGCTGTCAAAGGTATCTATTGGGCACGCC
GCGATGCGGAGCCGCACCGCCGTCGCATCGTCACCACCGAGGTGGAACACCACGCCGTACTG
GACTCGGTGAACTGGCTCGTGGAACACGAAGGCGCCCATGTGACCTGGCTGCCGACCGCCGC
CGACGGCTCGGTGTCGGCAACTGCGCTGCGCGAGGCACTGCAGAGCCACGACGACGTCGCGC
TGGTATCGGTGATGTGGGCCAACAACGAGGTCGGAACTATTCTACCGATCGCCGAAATGTCAGT
TGTCGCCATGGAATTCGGCGTGCCGATGCACAGTGATGCCATTCAGGCGGTGGGACAGCTCCC
GCTTGACTTCGGGGCCAGCGGGCTGTCGGCGATGAGCGTGGCCGGGCACAAATTCGGTGGCC
CGCCAGGAGTGGGTGCGTTGCTGCTGCGCCGCGACGTCACCTGCGTGCCCCTTATGCACGGC
GGTGGGCAGGAGCGCGATATTCGTTCCGGCACACCCGATGTCGCCAGTGCAGTTGGAATGGCG
ACGGCCGCGCAGATCGCGGTGGACGGACTCGAGGAAAACAGCGCGCGGTTACGGCTGCTGCG
GGATCGTCTGGTCGAGGGTGTGCTGGCTGAGATTGACGATGTTTGCCTTAACGGCGCCGATGA
CCCGATGCGGCTAGCGGGTAACGCGCACTTCACTTTCCGTGGCTGCGAAGGCGATGCGCTGTT
GATGTTGTTGGACGCTAACGGAATCGAGTGCTCAACCGGATCGGCCTGCACGGCAGGTGTAGC
GCAGCCCTCGCATGTGTTGATTGCAATGGGCGTCGACGCGGCCAGCGCCCGCGGATCATTGCG
TCTCTCGCTGGGGCACACCAGTGTTGAGGCTGATGTCGATGCCGCGTTGGAGGTGCTTCCCGG
GGCGGTGGCACGTGCACGGCGGGCCGCCCTAGCCGCCGCGGGAGCATCCCGATGA

>Rv3080c pknK serine-threonine protein kinase TB.seq 3442656:3445985 MW:119420
>emb|AL123456|MTBH37RV:c3445985-3442653, pknK SEQ ID NO:119
ATGACCGACGTTGATCCGCACGCGACGCGGCGGGACCTGGTCCCGAATATTCCCGCGGAACTG
CTTGAGGCTGGATTCGACAATGTCGAGGAGATCGGGCGCGGCGGATTCGGCGTCGTCTACCGC
TGCGTCCAGCCCTCGCTGGACCGCGCCGTCGCCGTCAAGGTATTGAGCACCGACCTGGATCGG
```

TABLE 3-continued

GACAATCTCGAGCGCTTCCTGCGCGAGCAGCGGGCCATGGGCCGCCTTTCCGGGCACCCGCA
CATCGTGACCGTCTTGCAGGTGGGCGTGTTGGCGGGTGGGCGGCCCTTCATCGTGATGCCCTA
CCACGCCAAGAATTCGTTGGAGACGCTGATTCGCCGGCACGGGCCGCTGGACTGGCGCGAGA
CGCTGTCGATCGGCGTCAAGCTCGCGGGAGCGCTGGAAGCCGCGCATCGCGTCGGCACCCTG
CACCGTGACGTGAAGCCGGGGAATATCCTGCTGACCGACTACGGGGAACCGCAGCTGACCGAT
TTCGGAATCGCCAGAATCGCCGGGGGTTTCGAGACGGCGACCGGGGTGATTGCCGGTTCCCCG
GCTTTCACCGCGCCGGAAGTTCTCGAAGGAGCATCGCCGACGCCCGCCTCTGACGTGTACTCC
CTGGGCGCGACGTTGTTCTGTGCGCTGACCGGCCATGCCGCCTACGAGCGCCGCAGCGGTGA
GCGGGTGATCGCCCAGTTCCTGCGGATCACCTCGCAGCCGATCCCCGACCTGCGGAAGCAGG
GACTGCCCGCGGACGTGGCCGCCGCCATCGAACGGGCGATGGCCCGCCATCCGGCGGATCGT
CCCGCGACCGCGGCAGACGTTGGCGAGGAGCTTCGCGACGTTCAGCGCCGCAACGGCGTCAG
CGTCGACGAGATGCCCCTCCCCGTCGAGCTGGGCGTGGAACGCCGACGCTCGCCCGAGGCGC
ACGCGGCGCATCGGCATACCGGCGGCGGCACCCCGACGGTCCCGACGCCTCCGACACCCGCG
ACCAAGTACCGGCCGTCGGTGCCCACCGGCTCGCTGGTCACCCGCAGCCGGCTCACCGACAT
CCTGCGCGCCGGCGGACGGCGCCGGCTGATCCTCATCCACGCGCCCTCGGGATTCGGCAAAA
GCACCCTGGCGGCGCAATGGCGGGAAGAGCTCTCGCGCGACGGCGCCGCGGTCGCCTGGCT
GACAATCGACAACGACGACAACAACGAGGTGTGGTTCTTGTCGCACCTGCTCGAGTCGATCCG
GCGGGTCCGGCCCACGCTGGCCGAGTCGTTGGGGCACGTGCTCGAAGAGCATGGGGATGACG
CCGGCCGCTACGTGTTGACTTCGCTGATCGACGAAATCCACGAAAACGACGACCGGATCGCGG
TGGTGATCGACGACTGGCATCGGGTGTCCGACAGCCGCACCCAAGCTGCCCTGGGTTTCCTGC
TGGACAACGGATGTCACCACCTGCAGCTCATCGTGACCAGCTGGTCTCGCGCCGGTTTGCCGG
TGGGCAGGTTGCGGATCGGCGACGAACTAGCCGAGATCGATTCGGCTGCTTTGCGCTTCGATA
CCGACGAGGCCGCCGCGCTGCTGAACGATGCTGGTGGTCTGCGATTGCCGCGCGCAGACGTG
CAGGCGCTGACTACCTCTACCGACGGGTGGGCCGCGGCGCTGCGGCTGGCCGCGCTGTCGCT
GCGCGGCGGGGGCGACGCGACCCAACTCCTGCGCGGACTTTCCGGCGCCAGTGACGTGATCC
ACGAATTCCTGAGCGAAAACGTGCTGGACACCCTGGAACCCGAACTGCGCGAATTCCTACTGGT
GGCATCGGTCACCGAACGCACGTGCGGCGGGCTGGCCTCGGCGCTGGCCGGGATCACCAATG
GGCGGGCGATGCTGGAAGAGGCCGAGCACCGCGGCTTGTTCCTGCAACGGACCGAAGACGAC
CCGAATTGGTTTCGCTTCCACCAAATGTTCGCCGACTTTCTCCACCGTCGCCTCGAACGTGGCG
GGTCGCACCGGGTGGCGGAACTGCACCGCAGGGCATCGGCCTGGTTCGCCGAGAACGGCTAC
CTGCACGAAGCCGTCGACCATGCACTGGCCGCGGGCGATCCCGCGCGCGCCGTCGATCTTGT
CGAGCAGGATGAAACGAACCTGCCGGAGCAGTCAAAGATGACCACACTTCTGGCAATCGTGCA
GAAACTGCCGACGTCGATGGTGGTTTCACGGGCCCGGCTCCAACTCGCCATCGCGTGGGCGAA
CATTCTGCTGCAACGGCCGGCGCCGGCCACCGGTGCCCTGAATCGTTTCGAAACGGCCCTTGG
CCGGGCCGAGCTTCCCGAGGCGACGCAGGCGGATCTGCGGGCCGAGGCAGACGTGTTGCGG
GCGGTCGCCGAGGTGTTCGCAGACCGGGTCGAGCGCGTGGATGACCTTCTCGCCGAGGCAAT
GTCGAGACCGGACACCCTGCCCCCGCGAGTCCCCGGGACCGCCGGCAACACCGCGGCGTTGG
CCGCGATCTGCCGCTTCGAGTTCGCCGAGGTATATCCACTGCTGGACTGGGCCGCGCCCTACC
AGGAAATGATGGGACCGTTCGGCACCGTTTATGCGCAGTGCTTGCGCGGCATGGCGGCCAGGA
ATCGGCTCGACATTGTCGCTGCGCTACAGAACTTCCGAACGGCGTTCGAGGTCGGCACGGCAG
TGGGGGCCCACTCGCACGCGGCGCGGCTTGCGGGTTCGCTGCTCGCCGAATTGCTCTACGAG
ACCGGCGATCTGGCCGGGGCTGGTCGTCTCATGGACGAGAGCTATCTGCTGGGTTCCGAGGG
GGGTGCAGTGGACTACCTGGCCGCCAGGTACGTGATCGGCGCGCGGGTCAAGGCGGCCCAGG
GGGATCATGAGGGTGCGGCTGATCGCCTGTCCACCGGAGGCGATACTGCCGTCCAGCTGGGG
CTGCCGCGCCTGGCTGCCCGAATCAACAACGAGCGGATCCGGCTGGGCATCGCGCTACCTGC
GGCGGTGGCCGCCGATTTGCTGGCACCCCGCACCATCCCCCGCGACAATGGAATCGCCACCAT
GACAGCCGAACTCGACGAGGACTCCGCGGTGCGCCTGTTGTCCGCCGGCGACTCCGCCGATC
GTGACCAAGCCTGCCAACGGGCCGGTGCTCTCGCCGCCGCCATCGACGGTACGCGCAGACCG
CTGGCGGCGCTGCAGGCGCAAATACTTCATATCGAAACGCTTGCCGCCACCGGACGGGAATCC
GATGCGCGAAACGAACTGGCGCCGGTAGCCACGAAGTGCGCCGAACTCGGGCTGTCACGTCT
GCTGGTCGATGCGGGACTGGCCTAA

>Rv3106 fprA adrenodoxin and NADPH ferredoxin reductase TB.seq 3474004:3475371 MW:49342 >emb|AL123456|MTBH37RV:3474004–3475374, fprA SEQ ID NO:120
ATGCGTCCCTATTACATCGCCATCGTGGGCTCCGGCCCGTCGGCGTTCTTCGCCGCGGCATCC
TTGCTGAAGGCCGCCGACACGACCGAGGACCTCGACATGGCCGTCGACATGCTGGAGATGTTG
CCGACTCCCTGGGGGCTGGTGCGCTCCGGGGTCGCGCCGGATCACCCCAAGATCAAGTCGAT
CAGCAAGCAATTCGAAAAGACGGCCGAGGACCCCCGCTTCCGCTTCTTCGGCAATGTGGTCGT
CGGCGAACACGTCCAGCCCGGCGAGCTCTCCGAGCGCTACGACGCCGTGATCTACGCCGTCG
GCGCGCAGTCCGATCGCATGTTGAACATCCCCGGTGAGGACCTGCCGGGCAGTATCGCCGCC
GTCGATTTCGTCGGCTGGTACAACGCACATCCACACTTCGAGCAGGTATCACCCGATCTGTCGG
GCGCCCGGGCCGTAGTTATCGGCAATGGAAACGTCGCGCTAGACGTGGCACGGATTCTGCTCA
CCGATCCCGACGTGTTGGCACGCACCGATATCGCCGATCACGCTTTGGAATCGCTACGCCCAC
GCGGTATCCAGGAGGTGGTGATCGTCGGGCGCCGAGGTCCGCTGCAGGCCGCGTTCACCACG
TTGGAGTTGCGCGAGCTGGCCGACCTCGACGGGGTTGACGTGGTGATCGATCCGGCGGAGCT
GGACGGCATTACCGACGAGGACGCGGCCGCGGTGGGCAAGGTCTGCAAGCAGAACATCAAGG
TGCTGCGTGGCTATGCGGACCGCGAACCCCGCCCGGGACACCGCCGCATGGTGTTCCGGTTCT
TGACCTCTCCGATCGAGATCAAGGGCAAGCGCAAAGTGGAGCGGATCGTGCTGGGCCGCAACG
AGCTGGTCTCCGACGGCAGCGGGCGAGTGGCGGCCAAGGACACCGGCGAGCGCGAGGAGCT
GCCAGCTCAGCTGGTCGTGCGGTCGGTCGGCTACCGCGGGGTGCCCACGCCCGGGCTGCCGT
TCGACGACCAGAGCGGGACCATCCCCAACGTCGGCGGCCGAATCAACGGCAGCCCCAACGAAT
ACGTCGTCGGGTGGATCAAGCGCGGGCCGACCGGGGTGATCGGGACCAACAAGAAGGACGCC
CAAGACACCGTCGACACCTTGATCAAGAATCTTGGCAACGCCAAGGAGGGCGCCGAGTGCAAG
AGCTTTCCGGAAGATCATGCCGACCAGGTGGCCGACTGGCTAGCAGCACGCCAGCCGAAGCTG
GTCACGTCGGCCCACTGGCAGGTGATCGACGCTTTCGAGCGGGCCGCCGGCGAGCCGCACGG
GCGTCCCCGGGTCAAGTTGGCCAGCCTGGCCGAGCTGTTGCGGATTGGGCTCGGCTGA >Rv3235 - TB.seq 3611296:3611934 MW:22659 >emb|AL123456|MTBH37RV:3611296–3611937, Rv3235 SEQ ID NO:121

TABLE 3-continued

ATGATGGCCAGCAACCAAACCGCTGCGCAACACTCGTCTGCCACTCTCCAGCAGGCTCCTCGTT
CGATCGATGATGCTGGAGGGTGCCCCTTGACCATCAGTCCTATCGCGAACTCACCGGGCGACA
CCTTCGCCGTCACACCCGTCGTCGAGTACGAGCCGCCGCCGCGAAACATCCCGCCGTGCGGG
CAATCATCGCACGCAGCCCGGCGGCCGCACACCCCGCAGCTAGCTCGCCGACAACCAATCAGG
CCGAGCGGCCGGGCACCGGCAGCGGTCACCTCCACGGCCAAGTCACCGCGGCTGCGTCAAGC
GGGGACCTTCGCCGATGCCGCGCTACGCCGAGTGCTGGAGGTCATCGACCGCCGCCGCCCGG
TGGGCCAGCTGCGCCCCCTGCTGGCACCCGGCCTCGTCGACTCCGTGCTCGCGGTGAGCCGC
ACGGCGGCCGGACACCAACAAGGCGCGGCCATGCTGCGCCGCATCCGGCTGACACCGGCCGG
ACCCGACACCGCGGACACCGCCGCCGAGGTCTTCGGCACCTACAGTCGCGGGGACCGGATCC
ATGCGATCGCCTGCCGGGTGGAACAACGGCCCGCCGGTAACGAAACCCGATGGCTGATGGTC
GCCCTGCACATCGGGTGA

>Rv3255c manA mannose-6-phosphate isomerase TB.seq 3635040:3636263 MW:43340
>emb|AL123456|MTBH37RV:c3636263–3635037, manA SEQ ID NO:122
GTGGAACTGCTACGTGGCGCGTTACGCACCTACGCTTGGGGATCGCGCACCGCTATCGCCGAA
TTCACCGGGCGTCCGGTGCCGGCCGCTCACCCCGAGGCCGAACTATGGTTCGGTGCACACCC
GGGTGATCCGGCTTGGCTGCAGACGCCGCATGGCCAAACCTCGTTGCTCGAAGCGTTGGTCGC
GGATCCGGAGGGGCAGCTCGGCTCCGCGTCGCGCGCGCGATTCGGCGATGTGTTGCCGTTCT
TGGTCAAGGTGTTGGCGGCCGACGAGCCACTATCGTTGCAGGCCCATCCGAGCGCCGAGCAG
GCGGTTGAGGGCTACCTGCGGGAAGAGCGAATGGGCATTCCGGTGTCCTCACCCGTCCGCAAC
TACCGCGACACCAGTCACAAGCCAGAGTTATTGGTGGCGCTGCAGCCGTTCGAGGCGCTGGCC
GGATTCCGGGAGGCGGCTCGCACCACCGAGCTGCTGCGGGCGCTGGCCGTATCCGACCTCGA
CCCGTTCATCGACTTGCTGAGCGAGGGGTCCGATGCCGATGGTTTGCGTGCGCTGTTCACCAC
CTGGATTACCGCACCCCAGCCCGACATCGACGTGCTGGTGCCTGCCGTGCTGGACGGCGCTAT
CCAGTACGTCAGCTCCGGCGCAACGGAATTTGGCGCCGAAGCCAAGACAGTGCTGGAACTCGG
CGAACGTTATCCCGGCGACGCCGGTGTGCTGGCGGCGTTGTTGCTCAACCGCATCAGCTTGGC
TCCTGGGGAGGCGATCTTCCTGCCGGCCGGCAACCTGCACGCCTATGTGCGTGGTTTCGGTGT
GGAAGTGATGGCCAACTCCGACAACGTGTTACGCGGTGGACTTACCCCTAAGCACGTCGATGT
GCCCGAGTTGTTGCGGGTGCTGGACTTCGCCCCCACGCCGAAGGCTCGGCTGCGGCCCCCGA
TCCGGCGCGAGGGGCTGGGGCTGGTCTTTGAGACGCCCACCGATGAGTTCGCGGCCACGCTA
CTGGTGCTCGACGGCGATCACCTCGGCCACGAGGTCGACGCGTCGTCCGGCCATGACGGTCC
ACAGATCTTGTTATGCACCGAGGGTTCGGCGACGGTGCACGGGAAGTGCGGGTCGCTCACGCT
ACAGCGCGGCACGGCCGCCTGGGTGGCGGCCGACGACGGCCCGATCCGGCTGACCGCCGGC
CAACCCGCCAAGCTGTTCAGGGCGACCGTCGGGTTGTGA >Rv3264c rmlA2 glucose-1-phosphate thymidyltransferase TB.seq 3644897:3645973 MW:37840
>emb|AL123456|MTBH37RV:c3645973–3644894, rmlA2 SEQ ID NO:123
TTGGCAACTCACCAAGTCGATGCGGTGGTCCTGGTCGGTGGCAAGGGTACCCGACTGCGGCCG
TTGACGCTGTCGGCGCCCAAGCCAATGCTGCCTACCGCCGGACTGCCGTTCCTCACCCATCTG
CTGTCGCGGATCGCCGCAGCGGGCATCGAGCACGTGATCCTGGGTACGTCCTACAAACCCGCA
GTCTTCGAAGCGGAGTTCGGCGACGGGTCCGCACTGGGCCTACAGATCGAATACGTGACCGAG
GAGCATCCCTTGGGGACTGGCGGCGGCATCGCCAACGTTGCCGGCAAGCTGCGCAACGACAC
CGCGATGGTGTTTAACGGCGATGTGCTCTCGGGCGCGGATCTGGCCCAACTGCTGGACTTCCA
CCGAAGCAATCGAGCCGATGTCACGCTGCAACTGGTGCGGGTGGGCGACCCGCGGGCATTCG
GCTGCGTACCCACCGACGAGGAGGACCGCGTAGTCGCCTTTCTGGAGAAGACGGAGGATCCG
CCGACCGACCAGATCAATGCCGGCTGCTATGTCTTCGAACGCAACGTCATCGACCGGATTCCGC
AGGGCCGGGAGGTTTCGGTGGAACGCGAGGTGTTCCCGGCCTTGCTCGCCGACGGCGACTGC
AAGATCTACGGCTATGTCGATGCCAGCTATTGGCGGGACATGGGCACACCGGAAGACTTCGTTC
GCGGATCGGCGGATCTGGTGCGCGGCATCGCCCCGTCTCCGGCCTTGCGTGGTCACCGCGGT
GAGCAGTTGGTGCACGACGGTGCGGCGGTATCTCCCGGTGCGTTGCTGATTGGCGGCACCGTC
GTGGGGCGTGGTGCCGAAATCGGCCCCGGCACCAGATTGGACGGCGCGGTCATCTTCGATGG
TGTCCGGGTGGAGGCCGGGTGCGTGATCGAGCGTTCGATCATCGGCTTCGGTGCTCGCATCGG
ACCGCGGGCGTTGATCCGCGACGGTGTGATCGGTGACGGGGCCGACATCGGCGCGCGCTGCG
AGTTGTTAAGTGGTGCCCGGGTATGGCCCGGTGTCTTTCTTCCCGACGGCGGGATCCGTTACTC
GTCCGACGTTTGA >Rv3368c - TB.seq 3780334:3780975 MW:23734 >emb|AL123456|MTBH37RV:c3780975–3780331, Rv3368c SEQ ID NO:124
ATGACCCTCAACCTGTCCGTCGACGAGGTCCTGACCACTACCCGCTCGGTGCGCAAGCGTCTC
GATTTCGACAAGCCGGTGCCACGCGACGTGCTGATGGAATGCCTCGAGCTGGCGCTGCAGGCG
CCCACCGGTTCCAATTCCCAAGGCTGGCAGTGGGTGTTCGTCGAGGACGCCGCCAAGAAAAAG
GCGATCGCCGACGTCTACCTGGCCAACGCCCGGGGCTACCTCAGCGGGCCGGCGCCCGAGTA
CCCCGACGGCGACACCCGCGGCGAGCGGATGGGGCGGGTCCGCGATTCGGCGACCTATCTCG
CCGAACACATGCACCGGGCGCCGGTGCTGCTGATCCCCTGCCTGAAAGGCCGGGAAGACGAG
TCGGCGGTGGGTGGCGTGTCGTTTTGGGCCTCACTGTTCCCGGCGGTGTGGAGCTTCTGCCTG
GCGCTGCGCTCCCGCGGGCTGGGTTCGTGCTGGACGACGCTGCACCTGCTCGACAACGGCGA
GCACAAGGTGGCCGACGTGCTCGGCATTCCCTACGACGAATACAGCCAAGGCGGGCTGCTTCC
GATCGCCTACACACAAGGCATCGACTTCCGGCCGGCCAAGCGGCTGCCGGCCGAGAGCGTGA
CGCACTGGAACGGCTGGTAA >Rv3382c lytB1 TB.seq 3796447:3797433 MW:34667 >emb|AL123456|MTBH37RV:c3797433–3796444, lytB SEQ ID NO:125
ATGGCTGAGGTGTTCGTGGGACCGGTCGCACAGGGATACGCTTCGGGTGAAGTCACGGTGCTG
TTGGCGTCGCCGCGGTCGTTTTGCGCCGGTGTAGAGCGTGCTATCGAGACGGTCAAGCGAGTG
CTTGACGTGGCCGAAGGCCCGGTGTATGTGCGCAAGCAAATCGTGCACAACACTGTTGTGGTT
GCCGAGTTGCGGGACCGGGGAGCAGTGTTCGTCGAGGATCTCGACGAGATTCCCGATCCGCC
GCCGCCGGGGGCGGTCGTGGTGTTCTCCGCGCATGGGGTTTCCCCGGCGGTGCGCGCGGGC
GCTGATGAGCGGGGACTGCAGGTCGTCGACGCGACCTGCCCACTGGTGGCGAAAGTCCACGC
TGAAGCCGCACGGTTTGCCGCGCGCGGTGACACGGTGGTCTTCATCGGGCACGCCGGACATG TABLE 3-continued AGGAGACCGAAGGCACGCTTGGCGTCGCTCCGCGGTCAACATTATTGGTGCAGACACCCGCTG
ATGTGGCAGCGTTGAACCTGCCCGAGGGTACCCAGCTATCGTATCTGACCCAGACAACCCTGG
CACTTGATGAAACTGCCGATGTCATTGATGCGCTGCGCGCGAGGTTTCCGACGTTGGGCCAACC
CCCCTCTGAAGACATCTGCTATGCCACCACGAACAGACAGCGTGCGCTGCAATCGATGGTCGGT
GAATGTGACGTTGTGTTGGTGATTGGCTCGTGCAATTCGTCGAATTCGCGGCGTCTGGTCGAGT
TGGCGCAGCGAAGTGGGACGCCGGCCTACTTGATTGACGGGCCTGATGACATTGAGCCCGAAT
GGCTGTCGTCGGTCTCGACGATCGGTGTCACCGCGGGAGCCTCCGCGCCGCCACGACTGGTG
GGGCAGGTGATTGATGCACTTCGCGGATACGCCTCGATCACCGTGGTGGAACGCTCGATAGCG
ACCGAGACGGTGCGATTCGGCCTTCCCAAACAGGTTCGCGCGCAATGA >Rv3418c groES 10 kD chaperone TB.seq 3836985:3837284 MW:10773
>emb|AL123456|MTBH37RV:c3837284–3836982, groES SEQ ID NO:126
GTGGCGAAGGTGAACATCAAGCCACTCGAGGACAAGATTCTCGTGCAGGCCAACGAGGCCGAG
ACCACGACCGCGTCCGGTCTGGTCATTCCTGACACCGCCAAGGAGAAGCCGCAGGAGGGCAC
CGTCGTTGCCGTCGGCCCTGGCCGGTGGGACGAGGACGGCGAGAAGCGGATCCCGCTGGACG
TTGCGGAGGGTGACACCGTCATCTACAGCAAGTACGGCGGCACCGAGATCAAGTACAACGGCG
AGGAATACCTGATCCTGTCGGCACGCGACGTGCTGGCCGTCGTTTCCAAGTAG >Rv3423c alr TB.seq 3840193:3841416 MW:43357
>emb|AL123456|MTBH37RV:c3841416–3840190, alr SEQ ID NO:127
GTGAAACGGTTCTGGGAGAATGTCGGAAAGCCAAACGACACGACAGATGGGCGGGGCACGACT
TCGTTGGCCATGACACCGATATCCCAGACACCTGGCCTCCTCGCCGAGGCCATGGTGGATCTG
GGCGCTATTGAACACAACGTGCGGGTGCTGCGTGAGCACGCCGGCCACGCGCAGCTGATGGC
GGTGGTCAAGGCCGACGGCTACGGTCACGGTGCTACGCGCGTCGCCCAAACCGCCCTGGGAG
CCGGTGCGGCCGAACTCGGCGTCGCCACCGTCGACGAGGCGCTAGCGCTGCGCGCTGATGGC
ATTACCGCACCGGTGCTGGCCTGGCTGCATCCGCCCGGCATCGACTTCGGGCCCGCGCTGCTG
GCCGACGTGCAGGTCGCGGTGTCCTCGCTGCGCCAACTCGACGAACTGTTGCACGCGGTGCG
CCGGACCGGCCGGACGGCGACGGTGACCGTCAAGGTGGATACCGGGCTGAACCGCAATGGCG
TGGGACCGGCACAATTCCCGGCCATGCTGACCGCGTTACGCCAAGCCATGGCCGAGGACGCC
GTCCGGCTGCGGGGGCTGATGTCGCATATGGTTTACGCCGACAAGCCTGACGATTCCATCAAC
GATGTTCAGGCCCAACGGTTTACCGCCTTTCTGGCGCAGGCCCGCGAACAAGGGGTGCGGTTC
GAGGTGGCGCATCTATCGAACTCATCAGCAACTATGGCGCGCCCCGACCTGACGTTCGACCTG
GTGCGGCCGGGCATCGCGGTGTATGGGCTAAGCCCGGTACCCGCCCTCGGTGACATGGGGCT
GGTGCCGGCGATGACCGTGAAATGTGCTGTTGCGCTGGTGAAATCGATTCGTGCGGGGGAGGG
CGTGTCGTATGGGCACACATGGATCGCGCCACGCGACACCAATCTGGCGCTGCTGCCGATCGG
TTACGCAGACGGCGTGTTCCGGTCGCTGGGCGGGCGGCTGGAGGTGCTGATCAACGGCAGAC
GATGCCCCGGTGTGGGGCGGATCTGCATGGACCAGTTCATGGTCGACCTGGGCCCCGGGCCG
CTTGATGTGGCCGAAGGCGACGAGGCGATTTTGTTCGGGCCGGGCATCCGGGGTGAGCCCAC
GGCTCAGGACTGGGCCGATCTTGTCGGCACCATCCACTACGAAGTGGTCACCAGCCCGCGAGG
ACGTATCACCAGGACCTATCGCGAGGCTGAAAACCGTTGA >Rv3490 otsA [alpha],-trehalose-phosphate synthase TB.seq 3908232:3909731 MW:55864
>emb|AL123456|MTBH37RV:3908232–3909734, otsA SEQ ID NO:128
ATGGCTCCCTCGGGAGGCCAGGAGGCGCAGATTTGCGATTCGGAGACCTTCGGGGACTCTGAC
TTCGTGGTGGTAGCCAATCGACTGCCCGTCGATCTGGAGCGTCTTCCCGACGGCAGCACAACC
TGGAAACGCAGCCCCGGAGGCTTGGTCACCGCCTTGGAGCCGGTGCTGCGGCGTCGGCGCGG
GGCCTGGGTCGGCTGGCCCGGCGTTAACGACGACGGGGCCGAACCCGACCTCCACGTGCTGG
ACGGCCCCATCATCCAAGACGAGCTGGAACTTCATCCGGTACGGCTGAGCACCACGGACATAG
CTCAGTACTACGAGGGATTCTCCAACGCCACACTGTGGCCGCTGTACCACGACGTCATCGTCAA
GCCGCTCTACCACCGCGAATGGTGGGATCGCTACGTCGACGTCAACCAGCGCTTTGCCGAGGC
CGCGTCGCGCGCCGCCGCCCACGGCGCAACCGTGTGGGTACAGGACTACCAGCTGCAGCTGG
TACCGAAGATGCTGCGCATGCTGCGGCCCGATCTGACCATCGGTTTCTTTTTGCACATCCCGTT
CCCGCCGGTAGAGCTGTTTATGCAGATGCCGTGGCGCACCGAGATCATCCAGGGCCTACTGGG
CGCCGACCTGGTGGGCTTCCATCTTCCGGGCGGTGCCCAGAATTTCCTGATCCTGTCCCGGCG
TCTGGTCGGCACCGACACTTCCCGCGGAACCGTCGGTGTGCGGTCGCGGTTCGGTGCGGCGG
TGCTCGGGTCCCGCACCATACGAGTTGGCGCCTTTCCTATCTCGGTTGACTCCGGCGCGCTCG
ACCACGCTGCCCGCGACCGCAACATCAGGCGCCGGGCCCGCGAGATTCGCACCGAACTGGGA
AATCCGCGCAAGATCCTGCTCGGTGTTGACCGGCTCGACTACACCAAGGGCATCGACGTACGG
CTGAAGGCCTTTTCCGAGCTGCTGGCCGAGGGCCGCGTCAAACGCGACGACACCGTCGTGGTC
CAGCTGGCTACCCCGAGCCGCGAGCGGGTGGAGAGCTACCAGACGCTGCGCAACGACATCGA
ACGCCAGGTCGGCCACATTAACGGCGAGTACGGTGAGGTTGGCCATCCGGTAGTGCATTACCT
GCATCGACCGGCTCCGCGCGACGAGCTTATCGCTTTCTTCGTGGCCAGCGACGTCATGCTGGT
CACCCCACTACGCGACGGGATGAACCTGGTGGCCAAGGAGTACGTCGCTTGCCGCAGCGATCT
TGGCGGTGCCCTGGTGCTCAGCGAATTCACCGGGGCCGCAGCCGAACTCCGGCACGCATACCT
GGTCAACCCGCACGACCTGGAAGGCGTCAAGGACGGGATAGAGGAAGCGCTCAACCAGACGG
AGGAGGCGGGCCGGCGGCGAATGCGGTCGCTGCGACGCCAAGTGCTCGCCCACGACGTGGA
CCGCTGGGCACAGTCGTTTCTCGACGCTCTCGCCGGGGCACACCCGAGGGGCCAAGGCTAA >Rv3598c lysS lysyl-tRNA synthase TB.seq 4041423:4042937 MW:55678
>emb|AL123456|MTBH37RV:c4042937–4041420, lysS SEQ ID NO:129
GTGAGTGCCGCTGACACAGCAGAAGACCTTCCTGAGCAGTTCCGGATTCGCCGGGACAAGCGC
GCTCGCTTGCTGGCCCAGGGGCGCGATCCCTATCCCGTCGCGGTGCCGCGCACTCACACGTTG
GCCGAGGTTCGCGCCGCCCACCCTGACTTGCCGATCGATACCGCGACCGAAGACATCGTCGGC
GTCGCGGGCCGAGTGATCTTTGCGCGCAACTCGGGAAAGCTATGCTTTGCGACACTTCAGGAC
GGCGATGGTACCCAGCTGCAAGTGATGATCAGCCTCGACAAGGTCGGCCAGGCTGCTCTCGAC
GCATGGAAAGCCGATGTCGACCTGGGCGACATCGTCTACGTGCATGGCGCGGTGATCAGTTCG
CGCCGCGGCGAGCTGTCCGTCCTGGCGGATTGCTGGCGGATCGCCGCCAAGTCGCTGCGGCC
GCTTCCCGTCGCGCACAAAGAGATGAGTGAAGAGTCGCGGGTTCGTCAGCGCTATGTTGACCT
CATAGTTCGACCGGAAGCGCGCGCGGTGGCTCGACTACGGATCGCCGTCGTCCGCGCGATCC TABLE 3-continued GGACGGCGCTTCAACGTCGTGGGTTCCTGGAAGTCGAGACGCCCGTCTTGCAGACGTTAGCCG
GTGGTGCGGCGGCCCGTCCGTTCGCCACTCATTCCAATGCCCTAGACATCGATCTGTACCTGCG
GATCGCGCCGGAACTGTTCCTCAAGCGCTGCATCGTGGGTGGTTTCGACAAGGTCTTCGAACTT
AATCGAGTGTTCCGAAACGAAGGAGCCGATTCCACGCATTCTCCGGAATTCTCCATGCTGGAGA
CCTACCAGACCTACGGAACCTATGACGATTCGGCAGTCGTCACCCGGGAGCTTATTCAAGAGGT
GGCCGATGAGGCGATCGGAACCAGACAACTGCCGTTGCCCGACGGCAGTGTCTATGACATCGA
CGGAGAATGGGCGACTATACAAATGTACCCGTCGCTGTCTGTGGCGCTCGGTGAAGAGATCAC
ACCGCAGACGACGGTCGATCGCTTACGTGGGATCGCCGATAGCCTTGGCCTGGAGAAAGACCC
AGCGATTCATGACAACCGTGGCTTCGGCCACGGCAAACTCATCGAGGAACTCTGGGAGCGCAC
AGTGGGCAAGAGCTTGAGCGCACCCACATTTGTCAAGGATTTCCGGTTCAGACAACGCCTTTG
ACCCGTCAGCACCGCAGTATCCCCGGCGTAACCGAGAAGTGGGACCTCTATCTGCGCGGAATC
GAACTTGCCACCGGCTACTCGGAATTAAGCGACCCGGTAGTCCAGCGGGAGAGATTCGCCGAC
CAGGCCCGTGCCGCGGCCGCTGGCGATGACGAAGCGATGGTGCTTGACGAGGATTTTCTGGCC
GCTCTGGAGTACGGCATGCCACCGTGCACCGGAACCGGAATGGGTATCGATCGGTTGTTGATG
TCTTTGACTGGGTTGTCAATTAGGGAGACAGTTTTGTTCCCGATTGTTCGACCACACTCCAACTG
A >Rv3600c - similar to *Bacillus subtilis* protein YacB TB.seq 4043041:4043856 MW:29274
>emb|AL123456|MTBH37RV:c4043856—4043038, Rv3600c SEQ ID NO:130
GTGCTGCTGGCGATTGACGTCCGCAACACCCACACCGTTGTGGGCCTGCTGTCCGGAATGAAA
GAGCACGCAAAGGTCGTGCAGCAGTGGCGGATACGCACCGAATCCGAAGTCACCGCCGACGAA
CTGGCACTGACGATCGACGGGCTGATCGGCGAGGATTCCGAGCGGCTCACCGGTACCGCCGC
CTTGTCCACGGTCCCGTCCGTGCTGCACGAGGTGCGGATAATGCTCGACCAGTACTGGCCGTC
GGTGCCGCACGTGCTGATCGAGCCCGGAGTACGCACCGGGATCCCTTTGCTCGTCGACAACCC
GAAGGAAGTGGGCGCAGACCGCATCGTGAACTGTTTGGCCGCCTATGACCGGTTCCGGAAGGC
CGCCATCGTCGTTGACTTTGGATCCTCGATCTGTGTTGATGTTGTATCGGCCAAGGGTGAATTTC
TTGGCGGCGCCATCGCGCCCGGGGTGCAGGTGTCTTCCGATGCCGCGGCGGCCCGCTCGGCG
GCATTGCGCCGCGTTGAACTTGCCCGCCCACGTTCGGTGGTTGGCAAGAACACCGTCGAATGC
ATGCAAGCCGGTGCGGTGTTCGGCTTCGCCGGGCTGGTAGACGGGTTGGTAGGCCGCATCCG
CGAGGACGTGTCCGGTTTCTCCGTCGACCACGATGTCGCGATCGTGGCTACCGGGCATACCGC
GCCCCTGCTGCTGCCGGAATTGCACACCGTCGACCATTACGACCAGCACCTGACCTTGCAGGG
TCTGCGGCTGGTGTTCGAGCGTAACCTCGAAGTCCAGCGCGGCCGGCTCAAGACGGCGCGCT
GA >Rv3606c folK 7,8-dihydro-6-hydroxymethylpterin pyrophosphokinase TB.seq
4048181:4048744 MW:20732 >emb|AL123456|MTBH37RV:c4048744—4048178, folK
SEQ ID NO:131
ATGACGCGGGTAGTGCTCTCGGTTGGCTCCAACCTGGGTGACCGCCTGGCACGATTGCGGTCG
GTCGCCGACGGTCTCGGCGATGCGTTGATTGCGGCTTCCCCGATATATGAGGCCGACCCCTGG
GGTGGGGTGGAGCAGGGGCAGTTCCTCAATGCGGTGCTGATCGCCGACGATCCTACCTGCGAA
CCGCGGGAGTGGCTGCGGCGGGCGCAGGAGTTCGAGCGCGCTGCGGGCAGGGTGCGTGGCC
AGCGCTGGGGTCCACGAAATCTCGACGTCGACCTGATCGCCTGCTACCAGACCTCGGCCACCG
AGGCTCTGGTCGAAGTGACCGCGCGGGAGAACCACCTCACGCTGCCGCGCACCCACTGGCGCAT
CTGCGGGCCTTTGTGTTGATCCCGTGGATTGCCGTCGACCCAACGGCGCAGCTGACGGTTGCC
GGGTGCCCGCGGCCCGTCACGCGACTGCTGGCCGAGCTGGAGCCCGCCGACCGCGACAGTGT
GCGGTTGTTTAGGCCGTCGTTCGATCTGAATAGCAGACACCCCGTCAGTCGGGCACCGGAAAG
CTGA >Rv3607c folX may be involved in folate biosynthesis TB.seq 4048744:4049142 MW:14553
>emb|AL123456|MTBH37RV:c4049142—4048741, folX SEQ ID NO:132
ATGGCTGACCGAATCGAACTGCGCGGCCTGACCGTGCATGGTCGGCACGGGGTCTACGACCAC
GAGCGAGTGGCCGGGCAGCGGTTTGTCATCGATGTCACCGTGTGGATAGACCTGGCCGAGGC
CGCCAACAGCGACGACTTGGCCGACACCTATGACTACGTGCGGCTGGCTTCGCGGGCGGCCG
AGATCGTCGCCGGACCCCCGCGGAAGCTGATCGAAACGGTCGGGGCCGAGATCGCTGATCAC
GTGATGGACGACCAGCGAGTGCATGCCGTTGAGGTGGCGGTACACAAGCCGCAGGCGCCCATT
CCGCAGACGTTCGACGATGTGGCGGTGGTGATCCGACGCTCACGGCGCGGCGGCCGCGGTTG
GGTAGTCCCGGCGGGCGGCGCGGTATGA >Rv3608c folP dihydropteroate synthase TB.seq 4049138:4049977 MW:28812
>emb|AL123456|MTBH37RV:c4049977—4049135, folP SEQ ID NO:133
GTGAGTCCGGCGCCCGTGCAGGTGATGGGGGTTCTAAACGTCACGGACGACTCTTTCTCGGAC
GGCGGGTGTTATCTCGATCTCGACGATGCGGTGAAGCACGGTCTGGCGATGGCAGCCGCAGGT
GCGGGCATCGTCGACGTCGGTGGTGAGTCGAGCCGGCCCGGTGCCACTCGGGTTGACCCGGC
GGTGGAGACGTCTCGTGTCATACCCGTCGTCAAAGAGCTTGCAGCACAAGGCATCACCGTCAG
CATCGATACCATGCGCGCGGATGTCGCTCGGGCGGCGTTGCAGAACGGTGCCCAGATGGTCAA
CGACGTGTCGGGTGGCGGGCCGATCCGGCGATGGGGCCGCTGTTGGCCGAGGCCGATGTG
CCGTGGGTGTTGATGCACTGGCGGGCGGTATCGGCCGATACCCCGCATGTGCCTGTGCGCTAC
GGCAACGTGGTGGCCGAGGTCCGTGCCGACCTGCTGGCCAGCGTCGCCGACGCGGTGGCCGC
AGGCGTCGACCCGGCAAGGCTGGTGCTCGATCCCGGGCTTGGATTCGCCAAGACGGCGCAAC
ATAATTGGGCGATCTTGCATGCCCTTCCGGAACTGGTCGCGACCGGAATCCCAGTGCTGGTGG
GTGCTTCGCGCAAGCGCTTCCTCGGTGCGTTGTTGGCCGGGCCCGACGGCGTGATGCGGCCA
ACCGATGGGCGTGACACCGCGACGGCGGTGATTTCCGCGCTGGCCGCACTGCACGGGGCCTG
GGGTGTGCGGGTGCATGATGTGCGGGCCTCGGTCGATGCCATCAAGGTGGTCGAAGCGTGGAT
GGGAGCGGAAAGGATAGAACGCGATGGCTGA >Rv3609c folE GTP cyclohydrolase | TB.seq 4049977:4050582 MW:22395
>emb|AL123456|MTBH37RV:c4050582—4049974, folE SEQ ID NO:134
ATGTCGCAGCTGGATTCGCGCAGCGCATCTGCTCGTATCCGTGTGTTCGACCAGCAACGTGCC
GAGGCCGCGGTGCGCGAATTGCTGTACGCGATCGGCGAGGATCCGGATAGGGACGGCTTGGT TABLE 3-continued AGCCACCCCGTCCCGGGTTGCCCGGTCATACCGCGAAATGTTCGCCGGGCTCTACACCGACCC
CGACTCGGTGTTGAACACCATGTTCGACGAAGACCACGACGAGCTGGTGTTGGTCAAGGAAATC
CCTATGTACTCCACCTGCGAACACCACCTGGTGGCGTTCCACGGTGTGGCCCACGTCGGCTAC
ATCCCGGGCGACGACGGCAGGGTGACCGGCTTGTCAAAGATCGCGCGACTGGTCGATCTGTAC
GCCAAGCGACCTCAGGTCCAGGAGCGGCTCACCAGTCAGATCGCCGATGCCCTGATGAAAAAA
CTCGATCCACGCGGGGTAATCGTGGTGATCGAGGCTGAGCATCTGTGCATGGCGATGCGCGGG
GTTCGCAAGCCCGGCTCGGTCACCACTACGTCGGCGGTGCGCGGACTGTTCAAAACCAATGCC
GCTTCTCGAGCCGAAGCGCTCGACCTCATTTTGCGGAAGTGA >Rv3610c ftsH inner membrane protein, chaperone TB.seq 4050601:4052880 MW:81987
>emb|AL123456|MTBH37RV:c4052880–4050598, ftsH SEQ ID NO:135
ATGAACCGGAAAAACGTGACTCGCACCATAACAGCGATCGCCGTCGTGGTGCTGCTCGGCTGG
TCGTTCTTTTACTTCAGCGACGACACCCGCGGCTACAAGCCCGTTGATACCTCGGTGGCGATAA
CACAGATCAACGGCGACAACGTCAAGAGCGCACAGATCGACGATCGCGAGCAACAGCTGCGGC
TGATCCTGAAGAAGGGTAACAACGAGACCGACGGGTCCGAGAAGGTCATCACCAAGTACCCCA
CCGGGTACGCCGTCGACCTGTTCAACGCGCTCAGCGCCAAAAACGCGAAGGTCAGCACGGTCG
TCAACCAGGGCAGCATCCTGGGCGAGCTGCTGGTCTACGTGCTGCCGCTGCTGTTGCTGGTGG
GGCTGTTCGTGATGTTCTCCCGCATGCAAGGCGGCGCCCGGATGGGCTTCGGGTTCGGCAAGT
CACGCGCCAAGCAACTGAGCAAGGACATGCCCAAGACCACCTTCGCCGACGTCGCAGGTGTCG
ACGAGGCGGTCGAGGAGCTCTACGAGATCAAGGACTTCCTGCAGAACCCCAGCAGGTACCAAG
CGCTGGGCGCCAAGATCCCCAAAGGCGTGCTGCTCTACGGGCCGCCGGGAACCGGTAAGACG
TTGCTGGCTCGTGCGGTGGCCGGCGAAGCCGGAGTGCCGTTCTTCACCATCTCCGGCTCCGAC
TTCGTCGAAATGTTCGTCGGCGTCGGCGCATCCCGTGTCAGAGACCTGTTCGAGCAGGCCAAG
CAGAACAGCCCGTGCATCATCTTCGTCGACGAGATCGACGCCGTCGGCCGACAAAGAGGCGCC
GGGCTGGGCGGCGGTCACGACGAGCGTGAGCAGACCCTCAACCAGTTGCTAGTCGAAATGGA
CGGTTTTGGCGATCGCGCCGGCGTCATCCTGATCGCGGCCACCAACCGGCCCGACATCCTGGA
CCCGGCGCTGTTGCGGCCGGGCCGCTTCGACCGCCAGATCCCGGTATCCAACCCCGATCTGG
CGGGTCGGCGGGCGGTGCTGCGCGTGCACTCCAAGGGCAAGCCGATGGCCGCGGACGCCGA
CCTCGACGGACTGGCCAAGCGGACCGTCGGCATGACCGGAGCCGACCTGGCCAACGTCATCA
ACGAGGCGGCGCTGCTGACCGCCCGGGAGAACGGCACCGTCATCACCGGTCCCGCCCTCGAG
GAAGCGGTGGACCGGGTGATCGGCGGCCCGCGCCGCAAAGGCCGGATCATCAGCGAGCAGGA
GAAGAAGATCACCGCCTATCACGAGGGCGGGCACACCCTGGCCGCTTGGGCGATGCCCGATAT
CGAGCCGATTTATAAGGTGACGATCCTGGCGCGCGGGCGTACCGGCGGGCACGCGGTGGCGG
TGCCGGAAGAAGACAAGGGCCTGCGGACCCGCTCGGAAATGATCGCGCAACTGGTGTTCGCGA
TGGGTGGGCGCGCCGCCGAAGAACTGGTGTTTCGTGAGCCGACCACCGGCGCGGTGTCCGAC
ATCGAGCAGGCCACCAAGATAGCGCGCTCAATGGTCACCGAATTTGGAATGAGCTCCAAGCTG
GGCGCGGTCAAATACGGCTCCGAACACGGCGACCCGTTCCTCGGACGTACCATGGGCACCCAG
CCGGACTACTCCCACGAGGTCGCCCGCGAGATCGACGAAGAGGTCCGCAAGCTTATCGAGGCG
GCGCATACCGAAGCGTGGGAAATCCTGACCGAATACCGCGACGTGCTGGACACTTTGGCCGGC
GAGCTGCTGGAAAAGGAGACCCTGCACCGACCCGAGCTGGAAAGCATCTTCGCTGACGTCGAA
AAGCGGCCGCGGCTCACCATGTTCGACGACTTCGGTGGCCGGATCCCGTCGGACAAACCGCCC
ATCAAGACACCCGGCGAGCTCGCGATCGAACGCGGCGAACCTTGGCCCCAGCCGGTCCCCGA
GCCGGCGTTCAAGGCGGCGATTGCGCAGGCTACCCAAGCCGCTGAGGCCGCCCGGTCCGACG
CCGGCCAAACCGGGCACGGCGCCAACGGTTCGCCCGCCGGCACCCACCGGTCCGGTGACCGC
CAGTACGGCTCCACCCAGCCTGACTACGGTGCCCCGGCGGGCTGGCATGCGCCGGGATGGCC
CCCAAGGTCATCTCATCGGCCCAGCTATAGCGGTGAACCGGCACCGACGTATCCGGGTCAGCC
CTACCCGACCGGTCAAGCCGATCCGGGTTCCGATGAGTCCTCGGCGGAGCAGGATGACGAGGT
CAGTCGGACCAAGCCGGCCCACGGCTGA >Rv3671c – TB.seq 4112322:4113512 MW:40722 >emb|AL123456|MTBH37RV:c4113512–4112319,
Rv3671c SEQ ID NO:136
ATGACCCCGTCGCAGTGGCTGGATATCGCCGTCTTGGCGGTCGCATTTATTGCAGCCATCTCCG
GCTGGCGTGCCGGTGCGCTGGGCTCAATGCTGTCGTTTGGCGGGGTGCTGCTGGGCGCGACA
GCCGGCGTGCTGCTGGCGCCGCATATCGTCAGTCAAATCAGCGCTCCGCGGGCCAAACTGTTT
GCCGCGCTGTTCCTGATCCTGGCACTGGTCGTAGTCGGCGAGGTCGCTGGTGTGGTGCTGGGC
CGCGCCGTCCGCGGGGCGATCCGTAACCGGCCGATCCGGTTGATCGACTCGGTCATTGGGGTA
GGGGTGCAGCTGGTCGTGGTGCTCACCGCGGCGTGGTTGTTGGCGATGCCGCTGACACAGTC
GAAAGAGCAGCCCGAGCTGGCTGCCGCGGTGAAGGGTTCGCGGGTGCTCGCCCGGGTCAACG
AGGCGGCACCCACCTGGCTGAAGACGGTGCCCAAGCGGCTGTCGGCCCTGCTGAACACCTCC
GGCCTGCCCGCGGTTTTGGAGCCGTTCAGCCGCACGCCGGTCATTCCAGTGGCCTCACCCGAC
CCAGCGCTGGTCAACAATCCGGTGGTGGCGGCCACCGAGCCAAGTGTCGTCAAAATCCGCAGC
CTGGCACCCAGATGCCAGAAAGTGTTGGAGGGCACCGGCTTCGTGATCTCACCCGATCGGGTG
ATGACCAACGCGCACGTGGTGGCCGGATCCAACAACGTCACGGTGTATGCCGGCGACAAGCCC
TTCGAGGCCACGGTGGTGTCCTACGACCCGTCGGTCGACGTAGCGATCCTGGCCGTTCCGCAC
TTGCCGCCGCCGCCGCTGGTCTTCGCTGCGGAGCCGGCGAAAACCGGTGCCGACGTTGTGGT
GCTGGGTTATCCCGGCGGCGGCAATTTCACTGCCACACCCGCCAGGATTCGCGAGGCCATCAG
ACTCAGTGGCCCCGATATTTACGGGGACCCGGAGCCGGTTACCCGCGACGTGTACACCATCAG
AGCCGATGTGGAGCAAGGTGATTCGGGTGGCCCCCTGATCGACCTCAACGGTCAGGTGCTCGG
TGTGGTGTTCGGCGCAGCCATCGACGACGCCGAAACTGGGTTTGTGCTGACGGCCGGCGAGGT
GGCGGGGCAGCTTGCCAAAATCGGTGCTACCCAACCGGTCGGCACCGGGGCCTGCGTCAGCT
GA >Rv3682 ponA2 TB.seq 4121913:4124342 MW:84637
>emb|AL123456|MTBH37RV:4121913–4124345, ponA' SEQ ID NO:137
ATGCCCGAGCGCCTCCCGGCCGCGATCACCGTTCTGAAGCTGGCTGGGTGCTGTCTGTTGGCC
AGTGTCGTCGCCACTGCGCTGACGTTCCCGTTCGCAGGCGGGCTAGGGCTGATGTCCAATCGT
GCCTCTGAGGTCGTTGCCAACGGCTCGGCCCAGCTGCTCGAGGGGGCAAGTGCCTGCGGTATCG
ACGATGGTCGACGCGAAGGGCAACACGATCGCGTGGCTGTACTCGCAGCGCCGGTTCGAGGT
GCCCTCGGACAAGATCGCCAACACGATGAAGCTGGCGATCGTCTCGATTGAAGATAAGCGGTTC TABLE 3-continued

```
GCCGACCACAGCGGCGTGGACTGGAAGGGCACCCTGACCGGCCTGGCGGGCTACGCGTCCG
GCGACCTCGACACGCGCGGCGGCTCGACGCTCGAACAACAGTACGTGAAGAACTACCAACTGC
TGGTGACAGCCCAAACCGATGCCGAGAAGCGAGCGGCCGTCGAAACCACTCCGGCCCGCAAG
CTTCGCGAGATCCGGATGGCACTCACGCTGGACAAGACCTTCACAAAATCTGAAATCCTGACCC
GATACTTGAACCTGGTCTCGTTCGGCAATAACTCGTTCGGCGTGCAGGACGCGGCGCAAACGTA
CTTCGGCATCAACGCGTCCGACCTGAATTGGCAGCAAGCGGCGCTGCTGGCCGGCATGGTGCA
ATCGACCAGCACGCTCAACCCGTACACCAACCCCGACGGCGCGCTGGCCCGGCGGAACGTGG
TCCTCGACACCATGATCGAGAACCTTCCCGGGGAGGCGGAGGCGTTGCGTGCCGCCAAGGCC
GAGCCGCTGGGGGTACTGCCGCAGCCCAATGAGTTGCCGCGCGGCTGCATCGCGGCCGGCGA
CCGCGCATTCTTCTGCGACTACGTCCAGGAGTACCTGTCTCGGGCCGGGATCAGCAAGGAGCA
GGTCGCCACGGGCGGGTACCTGATCCGCACCACCCTGGACCCAGAGGTGCAGGCACCGGTCA
AGGCCGCCATCGACAAGTACGCCAGCCCGAACCTGGCCGGTATTTCCAGCGTGATGAGCGTGA
TCAAACCGGGTAAGGATGCGCACAAGGTGTTGGCCATGGCCAGTAACCGCAAATACGGGCTGG
ATCTAGAAGCCGGCGAAACCATGCGGCCGCAGCCATTCTCCCTGGTTGGCGACGGCGCCGGGT
CTATCTTCAAGATCTTCACCACGGCCGCTGCTCTGGACATGGGCATGGGTATTAACGCCCAACT
CGACGTGCCGCCCCGATTCCAGGCCAAAGGTCTGGGAAGTGGCGGGGCAAAGGGGTGCCCCA
AAGAGACCTGGTGTGTGGTGAACGCCGGCAACTACCGCGGCTCGATGAATGTCACCGACGCGC
TGGCAACCTCGCCAAACACCGCGTTCGCCAAGCTGATCTCGCAGGTCGGGGTGGGGCGTGCG
GTCGATATGGCCATCAAACTCGGGCTGAGGTCTTATGCGAATCCCGGCACCGCACGCGACTAC
AACCCCGACAGCAATGAGAGCTTGGCTGACTTCGTCAAACGACAGAACCTGGGTTCGTTCACCC
TCGGCCCCATCGAGTTAAACGCGCTGGAGCTGTCCAACGTGGCGGCCACGTTGGCATCCGGCG
GCGTGTGGTGCCCCCCCAACCCAATCGACCAGCTCATCGACCGCAACGGCAACGAAGTCGCGG
TCACCACCGAGACGTGCGACCAGGTGGTGCCCGCAGGGCTGGCGAACACCCTCGCCAACGCG
ATGAGCAAGGACGCCGTGGGCAGCGGCACGGCGGCCGGTTCGGCCGGCGCGGCGGGCTGGG
ATCTGCCGATGTCCGGCAAAACCGGCACCACCGAGGCGCACCGGTCGGCCGGCTTCGTGGGC
TTCACCAACCGCTACGCGGCGGCGAACTACATCTACGACGACTCCAGCTCGCCGACAGATCTGT
GTTCCGGCCCGCTGCGCCATTGCGGCAGCGGCGACTTGTACGGCGGCAACGAGCCATCCCGC
ACCTGGTTCGCCGCGATGAAGCCGATCGCCAACAACTTCGGCGAAGTGCAGCTACCACCGACC
GATCCACGCTATGTCGACGGCGCACCAGGCTCACGGGTACCAAGCGTGGCCGGTCTGGATGTC
GACGCCGCACGCCAGCGCCTCAAGGACGCGGGCTTCCAGGTCGCCGACCAAACCAACTCGGT
CAACAGCTCCGCCAAGTATGGTGAGGTGGTCGGAACGTCGCCCAGCGGTCAAACAATTCCGGG
TTCGATCGTCACGATCCAGATCAGCAACGGCATCCCGCCGGCTCCGCCTCCGCCACCGCTGCC
TGAGGATGGTGGGCCGCCACCGCCGGTCGGATCGCAGGTGGTGGAGATTCCGGGGCTGCCGC
CGATCACCATTCCGCTGCTGGCGCCACCACCCCCAGCGCCTCCCCCGTAG
```

>Rv3721c dnaZX DNA polymerase III,[gamma] (dnaZ) and t (dnaX) TB.seq 4164995:4166728 MW:61892 >emb|AL123456|MTBH37RV:c4166728–4164992, dnaZX SEQ ID NO:138

```
GTGGCTCTCTACCGCAAGTACCGACCGGCAAGCTTCGCGGAGGTGGTGGGGCAGGAGCACGT
CACCGCGCCGCTGTCGGTGGCGCTGGATGCCGGCCGGATCAACCACGCGTACCTGTTCTCTGG
GCCGCGTGGCTGCGGAAAGACGTCGTCAGCGCGTATCCTGGCGCGGTCGTTGAACTGTGCGCA
GGGCCCTACCGCCAACCCGTGCGGGGTCTGCGAATCCTGCGTTTCGTTGGCGCCCAACGCCCC
CGGCAGCATCGACGTGGTAGAGCTGGATGCCGCCAGCCACGGCGGCGTGGACGACACCCGCG
AGCTGCGGGACCGCGCGTTCTATGCGCCGGTCCAGTCACGGTACCGGGTATTTATCGTCGACG
AGGCGCACATGGTGACCACCGCGGGATTCAACGCGCTGCTCAAGATCGTGGAGGAACCGCCC
GAACACCTGATCTTCATATTCGCCACCACCGAACCGGAGAAGGTACTGCCGACGATTCGGTCGC
GCACTCATCACTACCCGTTCCGGCTGCTGCCGCCGCGCACTATGCGGGCGTTGCTCGCGCGGA
TCTGCGAGCAGGAGGGCGTCGTCGTCGACGATGCGGTGTACCCGTTGGTGATCCGGGCCGGC
GGAGGTTCCCCACGGGATACGCTCTCGGTGCTGGACCAATTGCTGGCTGGGGCCGCGGACAC
CCACGTGACCTACACCCGGGCGCTGGGGCTGCTGGGTGTCACCGACGTCGCCCTGATCGACG
ACGCGGTCGACGCACTGGCCGCTTGCGATGCGGCCGCATTGTTCGGGGCGATCGAATCGGTGA
TCGATGGCGGACATGACCCTCGGCGTTTCGCTACCGATCTGCTGGAGCGATTCCGCGACCTGA
TTGTGCTGCAATCGGTTCCCGACGCGGCATCTCGCGGGGTGGTGGATGCGCCCGAAGACGCG
CTGGATCGGATGCGCGAGCAAGCCGCCCGGATCGGGCGGGCGACCCTGACCCGATATGCCGA
GGTGGTGCAGGCCGGGCTAGGCGAGATGCGCGGTGCGACCGCGCCGCGTCTGCTGCTGGAA
GTGGTTTGCGCGCGACTGCTGCTGCCCTCGGCGAGCGACGCCGAATCGGCACTGTTGCAGCG
GGTCGAACGGATCGAGACCCGGTTGGACATGTCGATCCCGGCGCCGCAAGCCGTACCACGCC
CGTCGGCTGCGGCTGCCGAGCCGAAACACCAGCCCGCGCGTGAACCGAGACCGGTGCTGGCC
CCCACACCGGCCTCGAGCGAACCCACCGTGGCCGCGGTTCGGTCCATGTGGCCGACGGTGCG
CGACAAGGTGCGCCTGCGCAGCCGTACCACCGAGGTGATGCTGGCGGGTGCCACCGTCCGTG
CGCTAGAGGACAACACGCTGGTGCTGACCCACGAATCGGCGCCGCTGGCGCGGCGGCTGTCC
GAACAGCGCAACGCCGATGTCCTCGCCGAGGCGCTTAAAGACGCGCTGGGAGTCAACTGGCG
GGTGCGGTGTGAGACCGGTGAACCGGCTGCGGCGGCATCACCCGTCGGCGGGGGAGCGAAC
GTGGCGACCGCCAAGGCCGTAAACCCTGCCCCCACAGCGAATTCCACTCAGCGCGACGAAGAG
GAGCACATGCTCGCCGAAGCCGGCCGTGGCGACCCGTCGCCGCGTCGCGACCCGGAAGAGGT
TGCACTCGAGCTGCTGCAGAACGAGCTGGGCGCGCGCCGGATAGACAACGCCTAG
```

>Rv3783 - TB.seq 4229255:4230094 MW:32337
>emb|AL123456|MTBH37RV:4229255–4230097, Rv3783 SEQ ID NO:139

```
ATGACATTCATGGATGCTCAAGCTAGCTTCCAGACACAGTCGCGGACACTGGCCCGCGTCCGA
GGCGATCTGGTCGACGGGTTCCGCCGCCACGAGCTGTGGCTGCACCTGGGCTGGCAGGACAT
CAAGCAGCGGTACCGCCGCTCGGTGCTGGGGCCGTTCTGGATCACCATCGCCACCGGAACGA
CCGCCGTCGCGATGGGCGGCCTGTATTCCAAGCTGTTTCGGCTCGAGCTGTCTGAGCACCTGC
CCTACGTCACGCTCGGGCTGATCGTCTGGAACCTGATCAACGCCGCCATCCTGGACGGCGCAG
AGGTTTTCGTCGCCAACGAAGGTCTGATCAAACAGCTGCCGGCACCGTTGAGCGTGCACGTCTA
TCGGTTGGTGTGGCGGCAGATGATCTTCTTCGCCCACAACATCGTCATCTACTTCGTCATCGCG
ATCATCTTTCCTAAGCCGTGGTCGTGGGCGGATCTGTCGTTTCTTCCGGCGCTGGCGCTCATTT
TCCTCAATTGCGTTTGGGTGTCACTGTGTTTCGGCATCCTGGCGACCCGCTACCGCGACATCGG
CCCGCTGCTGTTTTCCGTTGTGCAGTTGTTGTTCTTCATGACGCCGATCATCTGGAACGACGAGA
CCCTGCGTCGGCAGGGCGCGGGCCGCTGGTCGAGCATCGTCGAGCTCAACCCGCTGCTGCAC
```

TABLE 3-continued

```
TATCTGGACATCGTGCGGGCGCCACTGTTGGGCGCTCACCAGGAGCTGCGGCACTGGCTGGTG
GTGCTGGTGTTGACCGTCGTCGGCTGGATGCTGGCGGCGTTCGCGATGCGGCAGTATCGCGC
GCGGGTGCCCTACTGGGTGTAG

>Rv3789 - TB.seq 4235371:4235733 MW:13378
>emb|AL123456|MTBH37RV:4235371-4235736, Rv3789 SEQ ID NO:140
ATGCGGTTCGTTGTCACCGGCGGCCTCGCTGGGATAGTTGACTTTGGCCTCTACGTCGTGCTGT
ACAAGGTGGCGGGCCTACAGGTCGACCTGTCCAAGGCCATCAGCTTCATCGTCGGCACCATCA
CCGCGTACCTGATCAACCGCCGGTGGACATTCCAGGCCGAGCCCAGCACGGCCCGATTCGTCG
CGGTCATGCTCCTCTACGGAATCACCTTCGCCGTGCAGGTCGGACTCAACCACCTCTGCCTCGC
ACTCTTGCACTACCGGGCGTGGGCCATCCCCGTCGCGTTTGTGATCGCGCAGGGCACCGCCAC
GGTAATCAACTTCATCGTGCAGCGAGCCGTGATCTTCCGGATCCGCTGA

>Rv3790 - TB.seq 4235776:4237158 MW:50164
>emb|AL123456|MTBH37RV:4235776-4237161, Rv3790 SEQ ID NO:141
ATGTTGAGCGTGGGAGCTACCACTACCGCCACCCGGCTGACCGGGTGGGGCCGCACAGCGCC
GTCGGTGGCGAATGTGCTTCGCACCCCAGATGCCGAGATGATCGTCAAGGCGGTGGCTCGGGT
CGCCGAGTCGGGGGGCGGCCGGGGTGCTATCGCGCGCGGGCTGGGCCGCTCCTATGGGGAC
AACGCCCAAAACGGCGGTGGGTTGGTGATCGACATGACGCCGCTGAACACTATCCACTCCATTG
ACGCCGACACCAAGCTGGTCGACATCGACGCCGGGGTCAACCTCGACCAACTGATGAAAGCCG
CCCTGCCGTTCGGGCTGTGGGTCCCGGTGCTGCCGGGAACCCGGCAGGTCACCGTCGGCGGG
GCGATCGCCTGCGATATCCACGGCAAGAACCATCACAGCGCTGGCAGCTTCGGTAACCACGTG
CGCAGCATGGACCTGCTGACCGCCGACGGCGAGATCCGTCATCTCACTCCGACCGGCGAGGA
CGCCGAACTGTTCTGGGCCACCGTCGGGGGCAACGGTCTCACCGGCATCATCATGCGGGCCAC
CATCGAGATGACGCCCACTTCGACGGCGTACTTCATCGCCGACGGCGACGTCACCGCCAGCCT
CGACGAGACCATCGCCCTGCACAGCGACGGCAGCGAAGCGCGCTACACCTATTCCAGTGCCTG
GTTCGACGCGATCAGCGCTCCCCCGAAGCTGGGCCGCGCGGCGGTATCGCGTGGCCGCCTGG
CCACCGTCGAGCAATTGCCTGCGAAACTGCGGAGCGAACCTTTGAAATTCGATGCGCCACAGCT
ACTTACGTTGCCCGACGTGTTTCCCAACGGGCTGGCCAACAAATATACCTTCGGCCCGATCGGC
GAACTGTGGTACCGCAAATCCGGCACCTATCGCGGCAAGGTCCAGAACCTCACGCAGTTCTACC
ATCCGCTGGACATGTTCGGCGAATGGAACCGCGCCTACGGCCCAGCGGGCTTCCTGCAATATC
AGTTCGTGATCCCCACAGAGGCGGTTGATGAGTTCAAGAAGATCATCGGCGTTATTCAAGCCTC
GGGTCACTACTCGTTTCTCAACGTGTTCAAGCTGTTCGGCCCCCGCAACCAGGCGCCGCTCAGC
TTCCCCATCCCGGGCTGGAACATCTGCGTCGACTTCCCCATCAAGGACGGGCTGGGGAAGTTC
GTCAGCGAACTCGACCGCCGGGTACTGGAATTCGGCGGCCGGCTCTACACCGCCAAAGACTCC
CGTACCACCGCCGAAACCTTTCATGCCATGTATCCGCGCGTCGACGAATGGATCTCCGTGCGCC
GCAAGGTCGATCCGCTGCGCGTATTCGCCTCCGACATGGCCCGACGCTTGGAGCTGCTGTAG

>Rv3791 - TB.seq 4237162:4237923 MW:27470
>emb|AL123456|MTBH37RV:4237162-4237926, Rv3791 SEQ ID NO:142
ATGGTTCTTGATGCCGTAGGAAACCCCCAGACGGTGCTGCTGCTCGGTGGCACCTCCGAGATC
GGGCTCGCCATCTGCGAGCGCTACCTGCACAATTCGGCGGCCCGCATCGTGCTGGCCTGCCTG
CCCGACGACCCACGGCGGGAGGACGCGGCCGCTGCGATGAAGCAGGCCGGCGCGCGGTCGG
TGGAGCTGATCGACTTTGACGCCCTGGATACCGACAGCCACCCGAAGATGATCGAGGCGGCCT
TCTCCGGCGGTGATGTGGACGTGGCTATCGTCGCGTTCGGCTTGCTCGGCGACGCCGAAGAGC
TGTGGCAGAACCAGCGCAAGGCGGTGCAGATCGCCGAAATCAACTACACCGCAGCGGTTTCGG
TGGGCGTGCTGCTGGCTGAGAAGATGCGCGCTCAGGGCTTCGGTCAGATCATCGCGATGAGCT
CGGCCGCCGGTGAGCGGGTGCGACGGGCGAACTTCGTCTACGGCTCCACCAAGGCCGGTCTG
GACGGGTTTTACCTGGGGTTGTCAGAAGCGCTGCGCGAGTACGGTGTTCGTGTGCTGGTGATC
CGGCCCGGCCAGGTGCGTACCCGGATGAGCGCGCACCTCAAGGAAGCTCCATTGACCGTCGA
CAAGGAGTACGTCGCCAACCTCGCGGTGACCGCGTCCGCAAAAGGTAAGGAATTGGTTTGGGC
GCCAGCAGCGTTCCGCTACGTCATGATGGTGTTGCGTCACATCCCGCGGAGCATCTTCCGCAA
GCTGCCCATCTGA

>Rv3794 embA TB.seq 4243230:4246511 MW:115694
>emb|AL123456|MTBH37RV:4243230-4246514, embA SEQ ID NO:143
GTGCCCCACGACGGTAATGAGCGATCTCACCGGATCGCACGCCTAGCAGCCGTCGTCTCGGGA
ATCGCGGGTCTGCTGCTGTGCGGCATCGTTCCGCTGCTTCCGGTGAACCAAACCACCGCGACC
ATCTTCTGGCCGCAGGGCAGCACCGCCGACGGCAACATCACCCAGATCACCGCCCCTCTGGTA
TCCGGGGCGCCACGCGCGCTGGACATCTCGATCCCCTGCTCGGCCATCGCCACGCTGCCCCGC
CAACGGCGGCCTGGTGCTGTCCACACTGCCGGCCGGTGGCGTGGATACCGGTAAGGCCGGGC
TGTTCGTCCGCGCCAACCAGGACACGGTCGTCGTGGCGTTCCGCGACTCGGTGGCCGCGGTG
GCGGCCCGCTCCACGATCGCAGCGGGAGGCTGTAGCGCGCTGCATATCTGGGCCGATACCGG
CGGCGCGGGCGCTGATTTTATGGGTATACCCGGCGGCGCCGGGACCCTGCCGCCGGAGAAGA
AGCCACAGGTTGGCGGCATCTTCACCGACCTGAAGGTCGGAGCGCAGCCCGGGCTGTCGGCC
CGCGTCGACATCGACACTCGGTTTATCACGACGCCCGGCGCGCTCAAGAAGGCCGTGATGCTC
CTCGGCGTGCTGGCGGTCCTGGTAGCCATGGTGGGGCTGGCCGCGCTGGACCGGCTCAGCAG
GGGCCGCACCCTGCGCGACTGGCTGACCCGATATCGCCCGCGGGTGCGGGTCGGATTCGCCA
GCCGGCTCGCTGACGCAGCGGTGATCGCGACCTTGTTGCTCTGGCATGTCATCGGCGCCACCT
CGTCCGATGACGGCTACCTTCTGACCGTCGCCCGGGTCGCCCCGAAGGCCGGCTATGTAGCCA
ACTACTACCGGTATTTCGGCACGACGGAGGCGCCGTTCGACTGGTATACATCGGTGCTTGCCCA
GCTGGCGGCGGTGAGCACCGCCGGCGTCTGGATGCGCCTGCCCGCCACCCTGGCCGGAATCG
CCTGCTGGCTGATCGTCAGCCGTTTCGTGCTGCGGCGGCTGGGACCGGGCCCGGGCGGGCTG
GCGTCCAACCGGGTCGCTGTGTTCACCGCTGGTGCGGTGTTCCTGTCCGCCTGGCTGCCGTTC
AACAACGGCCTGCGTCCCGAGCCGCTGATCGCGCTGGGTGTGCTGGTCACGTGGGTGTTGGTG
GAACGGTCGATCGCGCTCGGACGGCTGGCCCCGGCCGCGGTAGCCATCATCGTGGCGACGCT
TACCGCGACGCTGGCACCGCAGGGGTTGATCGCGCTGGCCCCGCTGCTGACTGGTGCGCGCG
CCATCGCCCAGAGGATCCGGCGCCGCCGGGCGACCGATGGACTGCTGGCGCCGCTGGCGGT
GCTGGCCGCGGCGTTGTCGCTGATCACCGTGGTGGTGTTTCGGGACCAGACGCTGGCCACGGT
```

TABLE 3-continued

GGCCGAATCGGCACGCATCAAGTACAAGGTCGGCCCGACCATCGCCTGGTACCAGGACTTCCT
GCGCTACTACTTCCTTACCGTGGAGAGCAACGTTGAGGGGTCGATGTCCCGCCGGTTCGCGGT
GCTGGTGTTGCTGTTCTGCCTGTTCGGGGTGCTGTTCGTGCTGCTGCGGCGCGGCCGGGTGGC
GGGGCTGGCCAGCGGCCCGGCCTGGCGACTGATCGGCACTACGGCGGTCGGCCTGCTGCTGC
TCACGTTCACGCCAACCAAGTGGGCCGTGCAGTTCGGCGCATTCGCCGGGCTGGCCGGGGTGT
TGGGTGCGGTCACCGCGTTCACCTTTGCCCGCATCGGTCTACATAGTCGACGCAACCTCACGCT
GTACGTGACCGCGTTGCTGTTCGTGCTGGCGTGGGCAACCTCGGGCATCAACGGGTGGTTCTA
CGTCGGCAACTACGGGGTGCCGTGGTATGACATCCAGCCCGTCATCGCCAGCCACCCGGTGAC
GTCGATGTTTCTGACGCTGTCGATCCTCACCGGATTGCTGGCAGCCTGGTATCACTTCCGGATG
GACTACGCCGGGCACACCGAAGTCAAAGACAACCGGCGCAACCGCATCTTGGCCTCTACGCCA
CTGCTGGTGGTCGCGGTGATCATGGTCGCAGGCGAAGTCGGCTCGATGGCCAAGGCCGCGGT
GTTCCGTTACCCGCTTTACACCACCGCCAAGGCCAACCTGACCGCGCTCAGCACCGGGCTGTC
CAGCTGTGCGATGGCCGACGACGTGCTGGCCGAGCCCGACCCCAATGCCGGCATGCTGCAAC
CGGTTCCGGGCCAGGCGTTCGGACCGGACGGACCGCTGGGCGGTATCAGTCCCGTCGGCTTC
AAACCCGAGGGCGTGGGCGAGGACCTCAAGTCCGACCCGGTGGTCTCCAAACCCGGGCTGGT
CAACTCCGATGCGTCGCCCAACAAACCCAACGCCGCCATCACCGACTCCGCGGGCACCGCCGG
AGGGAAGGGCCCGGTCGGGATCAACGGGTCGCACGCGGCGCTGCCGTTCGGATTGGACCCGG
CACGTACCCCGGTGATGGGCAGCTACGGGGAGAACAACCTGGCCGCCACGGCCACCTCGGCC
TGGTACCAGTTACCGCCCCGCAGCCCGGACCGGCCGCTGGTGGTGGTTTCCGCGGCCGGCGC
CATCTGGTCCTACAAGGAGGACGGCGATTTCATCTACGGCCAGTCCCTGAAACTGCAGTGGGG
CGTCACCGGCCCGGACGGCCGCATCCAGCCACTGGGGCAGGTATTTCCGATCGACATCGGACC
GCAACCCGCGTGGCGCAATCTGCGGTTTCCGCTGGCCTGGGCGCCGCCGGAGGCCGACGTGG
CGCGCATTGTCGCCTATGACCCGAACCTGAGCCCTGAGCAATGGTTCGCCTTCACCCCGCCCC
GGGTTCCGGTGCTGGAATCTCTGCAGCGGTTGATCGGGTCAGCGACACCGGTGTTGATGGACA
TCGCGACCGCAGCCAACTTCCCCTGCCAGCGACCGTTTTCCGAGCATCTCGGCATTGCCGAGC
TTCCGCAGTACCGGATCCTGCCGGACCACAAGCAGACGGCGGCGTCGTCGAACCTATGGCAGT
CCAGCTCGACCGGCGGTCCGTTCCTGTTCACCCAGGCGCTGCTGCGCACCTCGACGATCGCCA
CGTACCTGCGTGGGGACTGGTATCGCGACTGGGGATCGGTGGAGCAGTACCACCGGCTGGTG
CCGGCCGATCAGGCTCCAGACGCCGTTGTCGAGGAGGGCGTGATCACTGTGCCCGGCTGGGG
TCGGCCAGGACCGATCAGGGCGCTGCCATGA

>Rv3795 embB TB.seq 4246511:4249804 MW:118023
>emb|AL123456|MTBH37RV:4246511–4249807, embB SEQ ID NO:144
ATGACACAGTGCGCGAGCAGACGCAAAAGCACCCCAAATCGGGCGATTTTGGGGGCTTTTGCG
TCTGCTCGCGGGACGCGCTGGGTGGCCACCATCGCCGGGCTGATTGGCTTTGTGTTGTCGGTG
GCGACGCCGCTGCTGCCCGTCGTGCAGACCACCGCGATGCTCGACTGGCCACAGCGGGGGCA
ACTGGGCAGCGTGACCGCCCCGCTGATCTCGCTGACGCCGGTCGACTTTACCGCCACCGTGCC
GTGCGACGTGGTGCGCGCCATGCCACCCGCGGGCGGGGTGGTGCTGGGCACCGCACCCAAG
CAAGGCAAGGACGCCAATTTGCAGGCGTTGTTCGTCGTCGTCAGCGCCCAGCGCGTGGACGTC
ACCGACCGCAACGTGGTGATCTTGTCCGTGCCGCGCGAGCAGGTGACGTCCCCGCAGTGTCAA
CGCATCGAGGTCACCTCTACCCACGCCGGCACCTTCGCCAACTTCGTCGGGCTCAAGGACCCG
TCGGGCGCGCCGCTGCGCAGCGGCTTCCCCGACCCCAACCTGCGCCCGCAGATTGTCGGGGT
GTTCACCGACCTGACCGGGCCCGCGCCGCCCGGGCTGGCGGTCTCGGCGACCATCGACACCC
GGTTCTCCACCCGGCCGACCACGCTGAAACTGCTGGCGATCATCGGGGCGATCGTGGCCACCG
TCGTCGCACTGATCGCGTTGTGGCGCCTGGACCAGTTGGACGGGCGGGGCTCAATTGCCCAGC
TCCTCCTCAGGCCGTTCCGGCCTGCATCGTCGCCGGGCGGCATGCGCCGGCTGATTCCGGCAA
GCTGGCGCACCTTCACCCTGACCGACGCCGTGGTGATATTCGGCTTCCTGCTCTGGCATGTCAT
CGGCGCGAATTCGTCGGACGACGGCTACATCCTGGGCATGGCCCGAGTCGCCGACCACGCCG
GCTACATGTCCAACTATTTCCGCTGGTTCGGCAGCCCGGAGGATCCCTTCGGCTGGTATTACAA
CCTGCTGGCGCTGATGACCCATGTCAGCGACGCCAGTCTGTGGATGCGCCTGCCAGACCTGGC
CGCCGGGCTAGTGTGCTGGCTGCTGCTGTCGCGTGAGGTGCTGCCCCGCCTCGGGCCGGCGG
TGGAGGCCAGCAAACCCGCCTACTGGGCGGCGGCCATGGTCTTGCTGACCGCGTGGATGCCG
TTCAACAACGGCCTGCGGCCGGAGGGCATCATCGCGCTCGGCTCGCTGGTCACCTATGTGCTG
ATCGAGCGGTCCATGCGGTACAGCCGGCTCACACCGGCGGCGCTGGCCGTCGTTACCGCCGC
ATTCACACTGGGTGTGCAGCCCACCGGCCTGATCGCGGTGGCCGCGCTGGTGGCCGGCGGCC
GCCCGATGCTGCGGATCTTGGTGCGCCGTCATCGCCTGGTCGGCACGTTGCCGTTGGTGTCGC
CGATGCTGGCCGCCGGCACCGTCATCCTGACCGTGGTGTTCGCCGACCAGACCCTGTCAACGG
TGTTGGAAGCCACCAGGGTTCGCGCCAAAATCGGGCCGAGCCAGGCGTGGTATACCGAGAACC
TGCGTTACTACTACCTCATCCTGCCCACCGTCGACGGTTCGCTGTCGCGGCGCTTCGGCTTTTT
GATCACCGCGCTATGCCTGTTCACCGCGGTGTTCATCATGTTGCGGCGCAAGCGAATTCCCAGC
GTGGCCCGCGGACCGGCGTGGCGGCTGATGGGCGTCATCTTCGGCACCATGTTCTTCCTGATG
TTCACGCCCACCAAGTGGGTGCACCACTTCGGGCTGTTCGCCGCCGTAGGGGCGGCGATGGC
CGCGCTGACGACGGTGTTGGTATCCCCATCGGTGCTGCGCTGGTCGCGCAACCGGATGGCGTT
CCTGGCGGCGTTATTCTTCCTGCTGGCGTTGTGTTGGGCCACCACCAACGGCTGGTGGTATGTC
TCCAGCTACGGTGTGCCGTTCAACAGCGCGATGCCGAAGATCGACGGGATCACAGTCAGCACA
ATCTTTTTCGCCCTGTTTGCGATCGCCGCCGGCTATGCGGCCTGGCTGCACTTCGCGCCCCGC
GGCGCCGGCGAAGGGCGGCTGATCCGCGCGCTGACGACAGCCCCGGTACCGATCGTGGCCG
GTTTCATGGCGGCGGTGTTCGTCGCGTCCATGGTGGCCGGGATCGTGCGACAGTACCCGACCT
ACTCCAACGGCTGGTCCAACGTGCGGGCGTTTGTCGGCGGCTGCGGACTGGCCGACGACGTA
CTCGTCGAGCCTGATACCAATGCGGGTTTCATGAAGCCGCTGGACGGCGATTCGGGTTCTTGG
GGCCCCTTGGGCCCGCTGGGTGGAGTCAACCCGGTCGGCTTCACGCCCAACGGCGTACCGGA
ACACACGGTGGCCGAGGCGATCGTGATGAAACCCAACCAGCCCGGCACCGACTACGACTGGGA
TGCGCCGACCAAGCTGACGAGTCCTGGCATCAATGGTTCTACGGTGCCGCTGCCCTATGGGCT
CGATCCCGCCCGGGTACCGTTGGCAGGCACCTACACCACCGGCGCACAGCAACAGAGCACACT
CGTCTCGGCGTGGTATCTCCTGCCTAAGCCGGACGACGGGCATCCGCTGGTCGTGGTGACCGC
CGCGGGCAAGATCGCCGGCAACAGCGTGCTGCACGGGTACACCCCCGGGCAGACTGTGGTGC
TCGAATACGCCATGCCGGGACCCGGAGCGCTGGTACCCGCCGGGCGGATGGTGCCCGACGAC
CTATACGGAGAGCAGCCCAAGGCGTGGCGCAACCTGCGCTTCGCCCGAGCAAAGATGCCCGC
CGATGCCGTCGCGGTCCGGGTGGTGGCCGAGGATCTGTCGCTGACACCGGAGGACTGGATCG TABLE 3-continued CGGTGACCCCGCCGCGGGTACCGGACCTGCGCTCACTGCAGGAATATGTGGGCTCGACGCAG
CCGGTGCTGCTGGACTGGGCGGTCGGTTTGGCCTTCCCGTGCCAGCAGCCGATGCTGCACGC
CAATGGCATCGCCGAAATCCCGAAGTTCCGCATCACACCGGACTACTCGGCTAAGAAGCTGGAC
ACCGACACGTGGGAAGACGGCACTAACGGCGGCCTGCTCGGGATCACCGACCTGTTGCTGCG
GGCCCACGTCATGGCCACCTACCTGTCCCGCGACTGGGCCCGCGATTGGGGTTCCCTGCGCAA
GTTCGACACCCTGGTCGATGCCCCTCCCGCCCAGCTCGAGTTGGGCACCGCGACCCGCAGCG
GCCTGTGGTCACCGGGCAAGATCCGAATTGGTCCATAG >Rv3834c serS seryl-tRNA synthase TB.seq 4307655:4308911 MW:45293
>emb|AL123456|MTBH37RV:c4308911—4307652, serS SEQ ID NO:145
GTGATCGACCTGAAGCTGCTTCGTGAAAACCCCGACGCGGTACGCCGCTCACAACTCAGCCGC
GGCGAGGACCCGGCGCTGGTAGATGCCCTGCTGACGGCCGACGCCGCCCGCCGGGCCGTGA
TCTCGACCGCCGATTCGTTACGGGCCGAGCAGAAAGCCGCCAGCAAAAGCGTGGGTGGCGCG
TCTCCCGAAGAGCGCCCGCCGCTGCTGCGGCGCGCGAAGGAACTCGCCGAGCAGGTCAAAGC
CGCTGAGGCCGACGAGGTCGAAGCGGAGGCGGCGTTCACCGCGGCGCACCTGGCGATCTCGA
ATGTCATCGTGGACGGGGTACCCGCCGGCGGGGAGGACGACTACGCGGTGCTCGACGTCGTC
GGCGAGCCCAGCTACCTCGAGAACCCCAAGGACCACCTGGAGCTCGGCGAGTCGCTGGGCCT
GATCGACATGCAGCGCGGCGCCAAGGTGTCGGGTTCACGGTTCTACTTCCTGACCGGTCGGGG
TGCCCTACTGCAGCTTGGATTGCTGCAGCTGGCGCTGAAGCTAGCCGTCGACAACGGCTTTGTC
CCTACGATCCCGCCGGTGCTGGTGCGCCCGGAAGTGATGGTAGGCACGGGATTTCTAGGCGCC
CACGCCGAGGAGGTGTACCGGGTAGAGGGCGACGGCCTCTACCTTGTGGGCACCTCCGAGGT
ACCGCTGGCGGGGTATCACTCCGGCGAGATTCTGGACCTTTCCCGCGGGCCGCTGCGGTATGC
GGGCTGGTCGTCGTGTTTCCGACGTGAGGCCGGCAGCCATGGCAAGGACACGCGCGGCATCA
TCCGGGTGCACCAGTTCGACAAAGTCGAGGGCTTCGTCTACTGCACACCGGCCGACGCGGAGC
ACGAACATGAGCGGCTGCTGGGCTGGCAGCGCCAGATGCTGGCACGCATCGAGGTGCCGTAT
CGGGTCATCGACGTGGCCGCGGGTGATCTCGGCTCGTCGGCCGCCCGCAAGTTCGACTGCGA
GGCGTGGATTCCGACGCAGGGGCCTATCGCGAGCTGACGTCGACGTCGAACTGCACCACCTT
TCAGGCGCGCCGGTTGGCGACCCGCTACCGGGATGCCAGCGGCAAGCCGCAGATCGCGGCCA
CCCTCAACGGAACGCTGGCCACCACCCGGTGGCTGGTTGCGATCCTGGAGAACCACCAGCGG
CCCGACGGCAGCGTTAGAGTCCCGGACGCACTGGTTCCGTTCGTGGGTGTCGAAGTGCTGGAG
CCGGTCGCTTAG >Rv3907c pcnA polynucleotide polymerase TB.seq 4391631:4393070 MW:53057
>emb|AL123456|MTBH37RV:c4393070—4391628, pcnA SEQ ID NO:146
GTGCCGGAAGCCGTCCAGGAAGCCGATCTGCTAACCGCCGCTGCGGTTGCCTTGAACAGGCAT
GCTGCCTTATTGCGGGAACTCGGGTCGGTGTTCGCCGCCGCGGGACACGAGTTGTATCTGGTC
GGCGGTTCGGTGCGAGATGCACTGTTGGGCCGGTTGAGCCCCGACCTGGACTTCACCACCGAC
GCCCGTCCCGAGCGGGTGCAGGAGATCGTGCGGCCGTGGGCCGATGCGGTGTGGGATACCG
GAATCGAATTCGGCACCGTCGGCGTGGGTAAGAGCGACCACCGCATGGAGATCACCACATTCC
GTGCCGACAGCTACGACCGGGTTTCGCGTCATCCAGAGGTACGTTTCGGCGATTGCCTCGAGG
GCGATCTGGTCCGCCGCGACTTCACCACGAACGCAATGGCTGTGCGCGTCACCGCCACTGGGC
CGGGCGAATTCCTGGATCCGCTTGGTGGCTTGGCGGCGCTGCGGGCCAAGGTGTTAGACACCC
CGGCGGCGCCGTCGGGGTCCTTTGGCGACGATCCGTTGCGGATGCTGCGCGCCGCGCGGTTC
GTCTCGCAACTTGGATTCGCGGTGGCGCCGCGGGTGCGCGCGGCGATCGAAGAGATGGCGCC
GCAGTTGGCCCGAATCAGCGCCGAACGGGTGGCCGCCGAGCTGGACAAGCTGCTGGTCGGTG
AGGATCCGGCCGCGGGTATCGACCTGATGGTGCAGAGCGGTATGGGTGCTGTGGTCTTGCCTG
AAATCGGTGGGATGCGGATGGCGATCGACGAACATCACCAGCACAAGGACGTCTATCAGCATTC
CTTGACCGTGCTGCGGCAGGCGATCGCGCTGGAGGACGACGGCCCGGATCTGGTGTTGCGCT
GGGCGGCGCTGCTGCACGACATCGGCAAGCCCGCCACCCGCCGTCACGAACCCGACGGTGGG
GTGAGCTTCCATCACCACGAAGTGGTCGGCGCCAAGATGGTGCGCAAGCGGATGCGGGCGCT
GAAGTATTCCAAGCAGATGATCGACGACATCTCGCAGCTGGTCTACCTGCATCTGCGGTTTCAC
GGCTACGGCGATGGGAAATGGACCGACTCTGCGGTGCGCCGCTATGTCACCGACGCCGGGGC
CCTACTGCCACGGCTGCACAAGCTGGTGCGCGCCGACTGCACGACCCGCAACAAGCGCCGGG
CCGCGCGGTTGCAGGCCAGTTACGACCGGCTGGAAGAGCGGATCGCGGAGCTGGCCGCCCAG
GAGGATCTGGATCGGGTGCGCCCCGACCTGGACGGCAACCAGATCATGGCGGTGCTCGACATT
CCGGCGGGCCCGCAAGTCGGCGAGGCGTGGCGCTACTTGAAGGAGCTGCGGCTAGAGCGCG
GCCCGTTGTCCACCGAGGAGGCGACAACCGAGCTGCTGTCCTGGTGGAAATCACGGGGGAAC
CGCTAG

TABLE 4

>Rv0002 dnaN DNA polymerase III, b-subunit TB.seq 2052:3257 MW:42114 SEQ ID NO:147
MDAATTRVGLTDLTFRLLRESFADAVSWVAKNLPARPAVPVLSGVLLTGSDNGLTISGFDYEVSAEA
QVGAEIVSPGSVLVSGRLLSDITRALPNKPVDVHVEGNRVALTCGNARFSLPTMPVEDYPTLPTLPEE
TGLLPAELFAEAISQVAIAAGRDDTLPMLTGIRVEILGETVVLAATDRFRLAVRELKWSASSPDIEAAVL
VPAKTLAEAAKAGIGGSDVRLSLGTGPGVGKDGLLGISGNGKRSTTRLLDAEFPKFRQLLPTEHTAVA
TMDVAELIEAIKLVALVADRGAQVRMEFADGSVRLSAGADDVGRAEEDLVVDYAGEPLTIAFNPTYLT
DGLSSLRSERVSFGFTTAGKPALLRPVSGDDRPVAGLNGNGPFPAVSTDYVYLLMPVRLPG >Rv0003 recF DNA replication and SOS induction TB.seq 3280:4434 MW:42181 SEQ ID NO:148
VYVRHLGLRDFRSWACVDLELHPGRTVFVFGPNGYGKTNLIEALWYSTTLGSHRVSADLPLIRVGTDR
AVISTIVVNDGRECAVDLEIATGRVNKARLNRSSVRSTRDVVWGVLRAVLFAPEDLGLVRGDPADRRR
YLDDLAIVRRPAIMVRAEYERVLRQRTALLKSVPGARYRGDRGVFDTLEVWDSRLAEHGAELVAARI
DLVNQLAPEVKKAYQLLAPESRSASIGYRASMDVTGPSEQSDIDRQLLAARLLAALAARRDAELERG
VCLVGPHRDDLILRLGDQPAKGFASHGEAWSLAVALRLAAYQLLRVDGGEPVLLLDDVFAELDVMRR
RALATAAESAEQVLVTAAVLEDIPAGWDARRVHIDVRADDTGSMSVVLP TABLE 4-continued >Rv0005 gyrB DNA gyrase subunit B TB.seq 5123:7264 MW:78441 SEQ ID NO:149
MGKNEARRSALAPDHGTVVCDPLRRLNRMHATPEESIRIVAAQKKKAQDEYGAASITILEGLEAVRKR
PGMYIGSTGERGLHHLIWEVVDNAVDEAMAGYATTVNVVLLEDGGVEVADDGRGIPVATHASGIPTV
DVVMTQLHAGGKFDSDAYAISGGLHGVGVSVVNALSTRLEVEIKRDGYEWSQVYEKSEPLGLKQGA
PTKKTGSTVRFWADPAVFETTEYDFETVARRLQEMAFLNKGLTINLTDERVTQDEVVDEVVSDVAEA
PKSASERAAESTAPHKVKSRTFHYPGGLVDFVKHINRTKNAIHSSIVDFSGKGTGHEVEIAMQWNAG
YSESVHTFANTINTHEGGTHEEGFRSALTSVVNKYAKDRKLLKDKDPNLTGDDIREGLAAVISVKVSE
PQFEGQTKTKLGNTEVKSFVQKVCNEQLTHWFEANPTDAKVVVNKAVSSAQARIAARKARELVRRK
SATDIGGLPGKLADCRSTDPRKSELYVVEGDSAGGSAKSGRDSMFQAILPLRGKIINVEKARIDRVLK
NTEVQAIITALGTGIHDEFDIGKLRYHKIVLMADADVDGQHISTLLLTLLFRFMRPLIENGHVFLAQPPLY
KLKWQRSDPEFAYSDRERDGLLEAGLKAGKKINKEDGIQRYKGLGEMDAKELWETTMDPSVRVLRQ
VTLDDAAAADELFSILMGEDVDARRSFITRNAKDVRFLDV >Rv0006 gyrA DNA gyrase subunit A TB.seq 7302:9815 MW:92276 SEQ ID NO:150
MTDTTLPPDDSLDRIEPVDIEQEMQRSYIDYAMSVIVGRALPEVRDGLKPVHRRVLYAMFDSGFRPD
RSHAKSARSVAETMGNYHPHGDASIYDSLVRMAQPWSLRYPLVDGQGNFGSPGNDPPAAMRYTEA
RLTPLAMEMLREIDEETVDFIPNYDGRVQEPTVLPSRFPNLLANGSGGIAVGMATNIPPHNLRELADA
VFWALENHDADEEETLAAVMGRVKGPDFPTAGLIVGSQGTADAYKTGRGSIRMRGVVEVEEDSRG
RTSLVITELPYQVNHDNFITSIAEQVRDGKLAGISNIEDQSSDRVGLRIVIEIKRDAVAKVVINNLYKHTQ
LQTSFGANMLAIVDGVPRTLRLDQLIRYYVDHQLDVIVRRTTYRLRKANERAHILRGLVKALDALDEVI
ALIRASETVDIARAGLIELLDIDEIQAQAILDMQLRRLAALERQRIIDDLAKIEAEIADLEDILAKPERQRGI
VRDELAEIVDRHGDDRRTRIIAADGDVSDEDLIAREDVVVTITETGYAKRTKTDLYRSQKRGGKGVQG
AGLKQDDIVAHFFVCSTHDLILFFTTQGRVYRAKAYDLPEASRTARGQHVANLLAFQPEERIAQVIQIR
GYTDAPYLVLATRNGLVKKSKLTDFDSNRSGGIVAVNLRDNDELVGAVLCSAGDDLLLVSANGQSIR
FSATDEALRPMGRATSGVQGMRFNIDDRLLSLNVVREGTYLLVATSGGYAKRTAIEEYPVQGRGGK
GVLTVMYDRRRGRLVGALIVDDDSELYAVTSGGGVIRTAARQVRKAGRQTKGVRLMNLGEGDTLLAI
ARNAEESGDDNAVDANGADQTGN >Rv0014c pknB serine-threonine protein kinase TB.seq 15593:17470 MW:66511 SEQ ID NO:151
MTTPSHLSDRYELGEILGFGGMSEVHLARDLRLHRDVAVKVLRADLARDPSFYLRFRREAQNAAALN
HPAIVAVYDTGEAETPAGPLPYIVMEYVDGVTLRDIVHTEGPMTPKRAIEVIADACQALNFSHQNGIIH
RDVKPANIMISATNAVKVMDFGIARAIADSGNSVTQTAAVIGTAQYLSPEQARGDSVDARSDVYSLGC
VLYEVLTGEPPFTGDSPVSVAYQHVREDPIPPSARHEGLSADLDAVVLKALAKNPENRYQTAAEMRA
DLVRVHNGEPPEAPKVLTDAERTSLLSSAAGNLSGPRTDPLPRQDLDDTDRDRSIGSVGRWVAVVA
VLAVLTVVVTIAINTFGGITRDVQVPDVRGQSSADAIATLQNRGFKIRTLQKPDSTIPPDHVIGTDPAAN
TSVSAGDEITVNVSTGPEQREIPDVSTLTYAEAVKKLTAAGFGRFKQANSPSTPELVGKVIGTNPPAN
QTSAITNVVIIIVGSGPATKDIPDVAGQTVDVAQKNLNVYGFTKFSQASVDSPRPAGEVTGTNPPAGT
TVPVDSVIELQVSKGNQFVMPDLSGMFWVDAEPRLRALGWTGMLDKGADVDAGGSQHNRVVYQN
PPAGTGVNRDGIITLRFGQ >Rv0016c pbpA TB.seq 18762:20234 MW:51577 SEQ ID NO:152
MNASLRRISVTVMALIVLLLLNATMTQVFTADGLRADPRNQRVLLDEYSRQRGQITAGGQLLAYSVAT
DGRFRFLRVYPNPEVYAPVTGFYSLRYSSTALERAEDPILNGSDRRLFGRRLADFFTGRDPRGGNV
DTTINPRIQQAGWDAMQQGCYGPCKGAVVALEPSTGKILALVSSPSYDPNLLASHNPEVQAQAWQR
LGDNPASPLTNRAISETYPPGSTFKVITTAAALAAGATETEQLTAAPTIPLPGSTAQLENYGGAPCGDE
PTVSLREAFVKSCNTAFVQLGIRTGADALRSMARAFGLDSPPRPTPLQVAESTVGPIPDSAALGMTSI
GQKDVALTPLANAEIAATIANGGITMRPYLVGSLKGPDLANISTTVGYQQRRAVSPQVAAKLTELMVG
AEKVAQQKGAIPGVQIASKTGTAEHGTDPRHTPPHAWYIAFAPAQAPKVAVAVLVENGADRLSATGG
ALAAPIGRAVIEAALQGEP >Rv0017c rodA TB.seq 20234:21640 MW:50612 SEQ ID NO:153
MTTRLQAPVAVTPPLPTRRNAELLLLCFAAVITFAALLVVQANQDQGVPWDLTSYGLAFLTLFGSAHL
AIRRFAPYTDPLLLPVVALLNGLGLVMIHRLDLVDNEIGEHRHPSANQQMLWTLVGVAAFALVVTFLK
DHRQLARYGYICGLAGLVFLAVPALLPAALSEQNGAKIWIRLPGFSIQPAEFSKILLLIFFSAVLVAKRG
LFTSAGKHLLGMTLPRPRDLAPLLAAWVISVGVMVFEKDLGASLLLYTSFLVVVYLATQRFSWVVIGL
TLFAAGTLVAYFIFEHVRLRVQTWLDPFADPDGTGYQIVQSLFSFATGGIFGTGLGNGQPDTVPAAST
DFIIAAFGEELGLVGLTAILMLYTIVIIRGLRTAIATRDSFGKLLAAGLSSTLAIQLFIVVGGVTRLIPLTGLT
TPWMSYGGSSLLANYILLAILARISHGARRPLRTRPRNKSPITAAGTEVIERV >Rv0018c ppp TB.seq 21640:23181 MW:53781 SEQ ID NO:154
VARVTLVLRYAARSDRGLVRANNEDSVYAGARLLALADGMGGHAAGEVASQLVIAALAHLDDDEPG
GDLLAKLDAAVRAGNSAIAAQVEMEPDLEGMGTTLTAILFAGNRLGLVHIGDSRGYLLRDGELTQITK
DDTFVQTLVDEGRITPEEAHSHPQRSLIMRALTGHEVEPTLTMREARAGDRYLLCSDGLSDPVSDETI
LEALQIPEVAESAHRLIELALRGGGPDNVTVVVADVVDYDYGQTQPILAGAVSGDDDQLTLPNTAAG
RASAISQRKEIVKRVPPQADTFSRPRWSGRRLAFVVALVTVLMTAGLLIGRAIIRSNYYVADYAGSVSI
MRGIQGSLLGMSLHQPYLMGCLSPRNELSQISYGQSGGPLDCHLMKLEDLRPPERAQVRAGLPAGT
LDDAIGQLRELAANSLLPPCPAPRATSPPGRPAPPTTSETTEPNVTSSPASPSPTTSAPAPTGTTPAIP
TSASPAAPASPPTPWPVTSSPTMAALPPPPPQPGIDCRAAA >Rv0019c - TB.seq 23273:23737 MW:17153 SEQ ID NO:155
MQGLVLQLTRAGFLMLLWVFIWSVLRILKTDIYAPTGAVMMRRGLALRGTLLGARQRRHAARYLVVT
EGALTGARITLSEQPVLIGRADDSTLVLTDDYASTRHARLSMRGSEWYVEDLGSTNGTYLDRAKVTT
AVRVPIGTPVRIGKTAIELRP >Rv0020c - TB.seq 23864:25444 MW:56881 SEQ ID NO:156
MGSQKRLVQRVERKLEQTVGDAFARIFGGSIVPQEVEALLRREAADGIQSLQGNRLLAPNEYIITLGV
HDFEKLGADPELKSTGFARDLADYIQEQGWQTYGDVVVRFEQSSNLHTGQFRARGTVNPDVETHP
PVIDCARPQSNHAFGAEPGVAPMSDNSSYRGGQGQGRPDEYYDDRYARPQEDPRGGPDPQGGS TABLE 4-continued

```
DPRGGYPPETGGYPPQPGYPRPRHPDQGDYPEQIGYPDQGGYPEQRGYPEQRGYPDQRGYQDQ
GRGYPDQGQGGYPPPYEQRPPVSPGPAAGYGAPGYDQGYRQSGGYGPSPGGGQPGYGGYGEY
GRGPARHEEGSYVPSGPPGPPEQRPAYPDQGGYDQGYQQGATTYGRQDYGGGADYTRYTESPR
VPGYAPQGGGYAEPAGRDYDYGQSGAPDYGQPAPGGYSGYGQGGYGSAGTSVTLQLDDGSGRT
YQLREGSNIIGRGQDAQFRLPDTGVSRRHLEIRWDGQVALLADLNSTNGTTVNNAPVQEWQLADGD
VIRLGHSEIIVRMH
```

>Rv0032 bioF2 C-terminal similar to *B. subtilis* BioF TB.seq 34295:36607 MW:86245 SEQ ID NO:157

```
MPTGLGYDFLRPVEDSGINDLKHYYFMADLADGQPLGRANLYSVCFDLATTDRKLTPAWRTTIKRWF
PGFMTFRFLECGLLTMVSNPLALRSDTDLERVLPVLAGQMDQLAHDDGSDFLMIRDVDPEHYQRYL
DILRPLGFRPALGFSRVDTTISWSSVEEALGCLSHKRRLPLKTSLEFRERFGIEVEELDEYAEHAPVLA
RLWRNVKTEAKDYQREDLNPEFFAACSRHLHGRSRLWLFRYQGTPIAFFLNVWGADENYILLEWGI
DRDFEHYRKANLYRAALMLSLKDAISRDKRRMEMGITNYFTKLRIPGARVIPTIYFLRHSTDPVHTATL
ARMMMHNIQRPTLPDDMSEEFCRWEERIRLDQDGLPEHDIFRKIDRQHKYTGLKLGGVYGFYPRFT
GPQRSTVKAAELGEIVLLGTNSYLGLATHPEVVEASAEATRRYGTGCSGSPLLNGTLDLHVSLEQEL
ACFLGKPAAVLCSTGYQSNLAAISALCESGDMIIQDALNHRSLFDAARLSGADFTLYRHNDMDHLARV
LRRTEGRRRIIVVDAVFSMEGTVADLATIAELADRHGCRVYVDESHALGVLGPDGRGASAALGVLAR
MDVVMGTFSKSFASVGGFIAGDRPVVDYIRHNGSGHVFSASLPPAAAAATHAALRVSRREPDRRAR
VLAAAEYMATGLARQGYQAEYHGTAIVPVILGNPTVAHAGYLRLMRSGVYVNPVAPPAVPEERSGFR
TSYLADHRQSDLDRALHVFAGLAEDLTPQGAAL
```

>Rv0050 ponA1 TB.seq 53661:55694 MW:71119 SEQ ID NO:158

```
VVILLPMVTFTMAYLIVDVPKPGDIRTNQVSTILASDGSEIAKIVPPEGNRVDVNLSQVPMHVRQAVIAA
EDRNFYSNPGFSFTGFARAVKNNLFGGDLQGGSTITQQYVKNALVGSAQHGWSGLMRKAKELVIAT
KMSGEWSKDDVLQAYLNIIYFGRGAYGISAASKAYFDKPVEQLTVAEGALLAALIRRPSTLDPAVDPE
GAHARWNWVLDGMVETKALSPNDRAAQVFPETVPPDLARAENQTKGPNGLIERQVTRELLELFNID
EQTLNTQGLVVTTTIDPQAQRAAEKAVAKYLDGQDPDMRAAVVSIDPHNGAVRAYYGGDNANGFDF
AQAGLQTGSSFKVFALVAALEQGIGLGYQVDSSPLTVDGIKITNVEGEGCGTCNIAEALKMSLNTSYY
RLMLKLNGGPQAVADAAHQAGIASSFPGVAHTLSEDGKGGPPNNGIVLGQYQTRVIDMASAYATLAA
SGIYHPPHFVQKVVSANGQVLFDASTADNTGDQRIPKAVADNVTAAMEPIAGYSRGHNLAGGRDSA
AKTGTTQFGDTTANKDAWMVGYTPSLSTAVWVGTVKGDEPLVTASGAAIYGSGLPSDIWKATMDGA
LKGTSNETFPKPTEVGGYAGVPPPPPPPEVPPSETVIQPTVEIAPGITIPIGPPTTITLAPPPPAPPAAT
PTPPP
```

>Rv0051 - TB.seq 55694:57373 MW:61210 SEQ ID NO:159

```
VTGALSQSSNISPLPLAADLRSADNRDCPSRTDVLGAALANVVGGPVGRHALIGRTRLMTPLRVMFAI
ALVFLALGWSTKAACLQSTGTGPGDQRVANWDNQRAYYQLCYSDTVPLYGAELLSQGKFPYKSSWI
ETDSNGTPQLRYDGQIAVRYMEYPVLTGIYQYLSMAIAKTYTALSKVAPLPVVAEVVMFFNVAAFGLA
LAWLTTVWATSGLAGRRIWDAALVAASPLVIFQIFTNFDALATGLATSGLLAWARRRPVLAGVLIGLG
SAAKLYPLLFLYPLLLLGIRAGRLNALARTMAAAAATWLLVNLPVMLLFPRGWSEFFRLNTRRGDDM
DSLYNVVKSFTGWRGFDPTLGFWEPPLVLNTVVTLLFVLCCAAIAYIALTAPHRPRVAQLTFLTVASFL
LVNKVWSPQFSLWLVPLAVLALPHRRILLAWMTIDALVWVPRMYYLYGNPSRSLPEQWFTTTVLLRD
IAVMVLCGLVVWQIYRPGRDLVRTGGPGALPACGGVDDPVGGVFANAADAPPGRLPSWLRPRLGD
EHARERTPDAGRDRTFSGQHRA
```

>Rv0106 - TB.seq 124372:125565 MW:43701 SEQ ID NO:160

```
MRTPVILVAGQDHTDEVTGALLRRTGTVVVEHRFDGHVVRRMTATLSRGELITTEDALEFAHGCVSC
TIRDDLLVLLRRLHRRDNVGRIVVHLAPWLEPQPICWAIDHVRVCVGHGYPDGPAALDVRVAAVVTC
VDCVRWLPQSLGEDELPDGRTVAQVTVGQAEFADLLVLTHPEPVAVAVLRRLAPRARITGGVDRVEL
ALAHLDDNSRRGRTDTPHTPLLAGLPPLAADGEVAIVEFSARRPFHPQRLHAAVDLLLDGVVRTRGR
LWLANRPDQVMWLESAGGGLRVASAGKWLAAMAASEVAYVDLERRLFADLMWVYPFGDRHTAMT
VLVCGADPTDIVNALNAALLSDDEMASPQRWQSYVDPFGDWHDDPCHEMPDAAGEFSAHRNSGES
R
```

>Rv0125 - TB.seq 151146:152210 MW:34927 SEQ ID NO:161

```
MSNSRRRSLRWSWLLSVLAAVGLGLATAPAQAAPPALSQDRFADFPALPLDPSAMVAQVGPQVVNI
NTKLGYNNAVGAGTGIVIDPNGVVLTNNHVIAGATDINAFSVGSGQTYGVDVVGYDRTQDVAVLQLR
GAGGLPSAAIGGGVAVGEPVVAMGNSGGQGGTPRAVPGRVVALGQTVQASDSLTGAEETLNGLIQ
FDAAIQPGDSGGPVVNGLGQVVGMNTAASDNFQLSQGGQGFAIPIGQAMAIAGQIRSGGGSPTVHI
GPTAFLGLGVVDNNGNGARVQRVVGSAPAASLGISTGDVITAVDGAPINSATAMADALNGHHPGDVI
SVTWQTKSGGTRTGNVTLAEGPPA
```

>Rv0350 dnaK 70 kD heat shock protein, chromosome replication TB.seq 419833:421707 MW:66832 SEQ ID NO:162

```
MARAVGIDLGTTNSVVSVLEGGDPVVVANSEGSRTTPSIVAFARNGEVLVGQPAKNQAVTNVDRTV
RSVKRHMGSDWSIEIDGKKYTAPEISARILMKLKRDAEAYLGEDITDAVITTPAYFNDAQRQATKDAG
QIAGLNVLRIVNEPTAAALAYGLDKGEKEQRILVFDLGGGTFDVSLLEIGEGVVEVRATSGDNHLGGD
DWDQRVVDWLVDKFKGTSGIDLTKDKMAMQRLREAAEKAKIELSSSQSTSINLPYITVDADKNPLFLD
EQLTRAEFQRITQDLLDRTRKPFQSVIADTGISVSEIDHVVLVGGSTRMPAVTDLVKELTGGKEPNKG
VNPDEVVAVGAALQAGVLKGEVKDVLLLDVTPLSLGIETKGGVMTRLIERNTTIPTKRSETFTTADDN
QPSVQIQVYQGEREIAAHNKLLGSFELTGIPPAPRGIPQIEVTFDIDANGIVHVTAKDKGTGKENTIRIQ
EGSGLSKEDIDRMIKDAEAHAEEDRKRREEADVRNQAETLVYQTEKFVKEQREAEGGSKVPEDTLN
KVDAAVAEAKAALGGSDISAIKSAMEKLGQESQALGQAIYEAAQAASQATGAAHPGGEPGGAHPGS
ADDVVDAEVVDDGREAK
```

>Rv0351 grpE stimulates DnaK ATPase activity TB.seq 421707:422411 MW:24501 SEQ ID NO:163

```
VTDGNQKPDGNSGEQVTVTDKRRIDPETGEVRHVPPGDMPGGTAADAAHTEDKVAELTADLQRV
```

TABLE 4-continued

```
QADFANYRKRALRDQQAAADRAKASVVSQLLGVLDDLERARKHGDLESGPLKSVADKLDSALTGLG
LVAFGAEGEDFDPVLHEAVQHEGDGGQGSKPVIGTVMRQGYQLGEQVLRHALVGVVDTVVVDAAE
LESVDDGTAVADTAENDQADQGNSADTSGEQAESEPSGS

>Rv0352 dnaJ acts with GrpE to stimulate DnaK ATPase TB.seq 422450:423634 MW:41346
SEQ ID NO:164
MAQREWVEKDFYQELGVSSDASPEEIKRAYRKLARDLHPDANPGNPAAGERFKAVSEAHNVLSDPA
KRKEYDETRRLFAGGGFGGRRFDSGFGGGFGGFGVGGDGAEFNLNDLFDAASRTGGTTIGDLFGG
LFGRGGSARPSRPRRGNDLETETELDFVEAAKGVAMPLRLTSPAPCTNCHGSGARPGTSPKVCPTC
NGSGVINRNQGAFGFSEPCTDCRGSGSIIEHPCEECKGTGVTTRTRTINVRIPPGVEDGQRIRLAGQ
GEAGLRGAPSGDLYVTVHVRPDKIFGRDGDDLTVTVPVSFTELALGSTLSVPTLDGTVGVRVPKGTA
DGRILRVRGRGVPKRSGGSGDLLVTVKVAVPPNLAGAAQEALEAYAAAERSSGFNPRAGWAGNR

>Rv0363c fba fructose bisphosphate aldolase TB.seq 441266:442297 MW:36545
SEQ ID NO:165
MPIATPEVYAEMLGQAKQNSYAFPAINCTSSETVNAAIKGFADAGSDGIIQFSTGGAEFGSGLGVKDM
VTGAVALAEFTHVIAAKYPVNVALHTDHCPKDKLDSYVRPLLAISAQRVSKGGNPLFQSHMWDGSAV
PIDENLAIAQELLKAAAAAKIILEIEIGVVGGEEDGVANEINEKLYTSPEDFEKTIEALGAGEHGKYLLAA
TFGNVHGVYKPGNVKLRPDILAQGQQVAAAKLGLPADAKPFDFVFHGGSGSLKSEIEEALRYGVVKM
NVDTDTQYAFTRPIAGHMFTNYDGVLKVDGEVGVKKVYDPRSYLKKAEASMSQRVVQACNDLHCA
GKSLTH

>Rv0405 pks6 TB.seq 485729:489934 MW:147615 SEQ ID NO:166
MTDGSVTADKLQKWFREYLSTHIECHPNEVSLDVPIRDLGLKSIDVLAIPGDLGDRFGFCIPDLAVWD
NPSANDLIDSLLNQRSADSLRESHGHADRNTQGRGSINEPVAVIGVGCRFPGDIDGPERLWDFLTEK
KCAITAYPDRGFTNAGTFAESGGFLKDVAGFDNRFFDIPPDEALRMDPQQRLLLEVSWEALEHAGIIP
ESLRLSRTGVFVGVSSTDYVRLVSASAQQKSTIWDNTGGSSSIIANRISYFLDIQGPSIVIDTACSSSLV
AVHLACRSLSTWDCDIALVGGTNVLISPEPWGGFREAGILSQTGCCHAFDKSADGMVRGEGCGVIVL
QRLSDARLEGRRILAILTGSAVNQDGKSNGIMAPNPSAQIGVLENACKSARVDPLEIGYVEAHGTGTS
LGDRIEAHALGMVFGRKRPGSGPLMIGSIKPNIGHLEGAAGIAGLIKAVLMVERGSLLPSGGFTEPNP
AIPFTELGLRVVDELQEWPVVAGRPRRAGVSSFGFGGTNAHVIVEEAGSVGADTVSGRADVGGSGG
GVVAWVISGKTASALAAQAGRLGRYVRARPALDVVDVGYSLVSTRSVFDHRAVVVGQTRDELLAGL
AGVVAGRPEAGVVCGVGKPAGKTAFVFAGQGSQWLGMGSELYAAYPVFAEALDAVVDELDRHLRY
PLRDVIWGHDQDLLNTTEFAQPALFAVEVALYRLLMSWGVRPGLVLGHSVGELAAAHVAGALCLPD
AAMLVAARGRLMQALPAGGAMFAVQAREDEVAPMLGHDVSIAAVNGPASVVISGAHDAVSAIADRL
RGQGRRVHRLAVSHAFHSALMEPMIAEFTAVAAELSVGLPTIPVISNVTGQLVADDFASADYWARHIR
AVVRFGDSVRSAHCAGASRFIEVGPGGGLTSLIEASLADAQIVSVPTLRKDRPEPVSVMTAAAQGFV
SGMGLDWASVFSGYRPKRVELPTYAFQHQKFWLAPAPSVSDPTAAGQIGASDGGAELLASSGFAA
RLAGRSADEQLAAAIEVVCEHAAAVLGRDGAAGLDAGQAFADSGFNSLSAVELRNRLTAVTAVTLPA
TAIFDHPTPTELAQYLITQIDGHGSSAAAAANPAERIDALTDLFLQACDAGRDADGWKMVALASNTRE
RMSSPVRNNVSKNVALLADGISDVVVICIPTLTVLSDQREYRDIANAMTGRHSVYSLTLPGFDSSDAL
PQNADMIVETVSNAIIDVVGGSCRFVLSGYSSGGVLAYALCSHLSVKHQRNPLGVALIDTYLPSQIAN
PSMNEGFSPNDTGKGLSREVIRVARMLNRLTATRLTAAATYAAIFQAWEPGRSMAPVLNIVAKDRIAT
VENLREERINRWRTAAAEAAYSVAEVPGDHFGMMSTSSEAIATEIHDWISGLVRGPHR

>Rv0435c - ATPase of AAA-family TB.seq 522348:524531 MW:75315 SEQ ID NO:167
VTHPDPARQLTLTARLNTSAVDSRRGVVRLHPNAIAALGIREWDAVSLTGSRTTAAVAGLAAADTAV
GTVLLDDVTLSNAGLREGTEVIVSPVTVYGARSVTLSGSTLATQSVPPVTLRQALLGKVMTVGDAVSL
LPRDLGPGTSTSAASRALAAAVGISWTSELLTVTGVDPDGPVSVQPNSLVTWGAGVPAAMGTSTAG
QVSISSPEIQIEELKGAQPQAAKLTEWLKLALDEPHLLQTLGAGTNLGVLVSGPAGVGKATLVRAVCD
GRRLVTLDGPEIGALAAGDRVKAVASAVQAVRHEGGVLLITDADALLPAAAEPVASLILSELRTAVATA
GVVLIATSARPDQLDARLRSPELCDRELGLPLPDAATRKSLLEALLNPVPTGDLNLDEIASRTPGFVVA
DLAALVREAALRAASRASADGRPPMLHQDDLLGALTVIRPLSRSASDEVTVGDVTLDDVGDMAAAK
QALTEAVLWPLQHPDTFARLGVEPPRGVLLYGPPGCGKTFVVRALASTGQLSVHAVKGSELMDKWV
GSSEKAVRELFRRARDSAPSLVFLDELDALAPRRGQSFDSGVSDRVVAALLTELDGIDPLRDVVMLG
ATNRPDLIDPALLRPGRLERLVFVEPPDAAARREILRTAGKSIPLSSDVDLDEVAAGLDGYSAADCVAL
LREAALTAMRRSIDAANVTAADLATARETVRASLDPLQVASLRKFGTKGDLRS

>Rv0436c pssA CDP-diacylglycerol-serine o-phosphatidyltransferase TB.seq 524531:525388
MW:31219 SEQ ID NO:168
MIGKPRGRRGVNLQILPSAMTVLSICAGLTAIKFALEHQPKAAMALIAAAAILDGLDGRVARILDAQSR
MGAEIDSLADAVNFGVTPALVLYVSMLSKWPVGWVVVLLYAVCVVLRLARYNALQDDGTQPAYAHE
FFVGMPAPAGAVSMIGLLALKMQFGEGWWTSGWFLSFWVTGTSILLVSGIPMKKMHAVSVPPNYAA
ALLAVLAICAAAAVLAPYLLIWVIIIAYMCHIPFAVRSQRWLAQHPEVWDDKPKQRRAVRRASRRAHP
YRPSMARLGLRKPGRRL

>Rv0440 groEL 260 kD chaperonin 2 TB.seq 528606:530225 MW:56728 SEQ ID NO:169
MAKTIAYDEEARRGLERGLNALADAVKVTLGPKGRNVVLEKKWGAPTITNDGVSIAKEIELEDPYEKI
GAELVKEVAKKTDDVAGDGTTTATVLAQALVREGLRNVAAMGANPLGLKRGIEKAVEKVTETLLKGAK
EVETKEQIAATAAISAGDQSIGDLIAEAMDKVGNEGVITVEESNTFGLQLELTEGMRFDKGYISGYFVT
DPERQEAVLEDPYILLVSSKVSTVKDLLPLLEKVIGAGKPLLIIAEDVEGEALSTLVVNKIRGTFKSVAVK
APGFGDRRKAMLQDMAILTGGQVISEEVGLTLENADLSLLGKARKVVVTKDETTIVEGAGDTDAIAGR
VAQIRQEIENSDSDYDREKLQERLAKLAGGVAVIKAGAATEVELKERKHRIEDAVRNAKAAVEEGIVA
GGGVTLLQAAPTLDELKLEGDEATGANIVKVALEAPLKQIAFNSGLEPGVVAEKVRNLPAGHGLNAQT
GVYEDLLAAGVADPVKVTRSALQNAASIAGLFLTTEAVVADKPEKEKASVPGGGDMGGMDF

>Rv0482 murB TB.seq 570537:571643 MW:38522 SEQ ID NO:170
MKRSGVGSLFAGAHIAEAVPLAPLTTLRVGPIARRVITCTSAEQVVAALRHLDSAAKTGADRPLVFAG
GSNLVIAENLTDLTVVRLANSGITIDGNLVRAEAGAVFDDVVVRAIEQGLGGLECLSGIPGSAGATPVQ
```

TABLE 4-continued

NVGAYGAEVSDTITRVRLLDRCTGEVRWVSARDLRFGYRTSVLKHADGLAVPTVVLEVEFALDPSGR
SAPLRYGELIAALNATSGERADPQAVREAVLALRARKGMVLDPTDHDTWSVGSFFTNPVVTQDVYE
RLAGDAATRKDGPVPHYPAPDGVKLAAGWLVERAGFGKGYPDAGAAPCRLSTKHALALTNRGGAT
AEDVVTLARAVRDGVHDVFGITLKPEPVLIGCML

>Rv0483 - TB.seq 571708:573060 MW:47859 SEQ ID NO:171
VVIRVLFRPVSLIPVNNSSTPQSQGPISRRLALTALGFGVLAPNVLVACAGKVTKLAEKRPPPAPRLTF
RPADSAADVVPIAPISVEVGDGWFQRVALTNSAGKVVAGAYSRDRTIYTITEPLGYDTTYTWSGSAV
GHDGKAVPVAGKFTTVAPVKTINAGFQLADGQTVGIAAPVIIQFDSPISDKAAVERALTVTTDPPVEGG
WAWLPDEAQGARVHWRPREYYPAGTTVDVDAKLYGLPFGDGAYGAQDMSLHFQIGRRQVVKAEV
SSHRIQVVTDAGVIMDFPCSYGEADLARNVTRNGIHVVTEKYSDFYMSNPAAGYSHIHERWAVRISN
NGEFIHANPMSAGAQGNSNVTNGCINLSTENAEQYYRSAVYGDPVEVTGSSIQLSYADGDIWDWAV
DWDTWVSMSALPPPAAKPAATQIPVTAPVTPSDAPTPSGTPTTTNGPGG >Rv0489 gpm phosphoglycerate mutase I TB.seq 578424:579170 MW:27217 SEQ ID NO:172
MANTGSLVLLRHGESDWNALNLFTGWVDVGLTDKGQAEAVRSGELIAEHDLLPDVLYTSLLRRAITT
AHLALDSADRLWIPVRRSWRLNERHYGALQGLDKAETKARYGEEQFMAWRRSYDTPPPPIERGSQ
FSQDADPRYADIGGGPLTECLADVVARFLPYFTDVIVGDLRVGKTVLIVAHGNSLRALVKHLDQMSDD
EIVGLNIPTGIPLRYDLDSAMRPLVRGGTYLDPEAAAAGAAAVAGQGRG >Rv0490 senX 3sensor histidine kinase TB.seq 579347:580576 MW:44794 SEQ ID NO:173
VTVFSALLLAGVLSALALAVGGAVGMRLTSRVVEQRQRVATEWSGITVSQMLQCIVTLMPLGAAVVD
THRDVVYLNERAKELGLVRDRQLDDQAWRAARQALGGEDVEFDLSPRKRSATGRSGLSVHGHARL
LSEEDRRFAVVFVHDQSDYARMEAARRDFVANVSHELKTPVGAMALLAEALLASADDSETVRRFAE
KVLIEANRLGDMVAELIELSRLQGAERLPNMTDVDVDTIVSEAISRHKVAADNADIEVRTDAPSNLRVL
GDQTLLVTALANLVSNAIAYSPRGSLVSISRRRRGANIEIAVTDRGIGIAPEDQERVFERFFRGDKARS
RATGGSGLGLAIVKHVAANHDGTIRVWSKPGTGSTFTLALPALIEAYHDDERPEQAREPELRSNRSQ
REEELSR >Rv0500 proC pyrroline-5-carboxylate reductase TB.seq 590081:590965 MW:30172
SEQ ID NO:174
MLFGMARIAIIGGGSIGEALLSGLLRAGRQVKDLVVAERMPDRANYLAQTYSVLVTSAADAVENATFV
VVAVKPADVEPVIADLANATAAAENDSAEQVFVTVVAGITIAYFESKLPAGTPVVRAMPNAAALVGAG
VTALAKGRFVTPQQLEEVSALFDAVGGVLTVPESQLDAVTAVSGSGPAYFFLLVEALVDAGVGVGLS
RQVATDLAAQTMAGSAAMLLERMEQDQGGANGELMGLRVDLTASRLRAAVTSPGGTTAAALRELE
RGGFRMAVDAAVQAAKSRSEQLRITPE >Rv0528 - TB.seq 618303:619889 MW:57132 SEQ ID NO:175
MWRSLTSMGTALVLLFLLALAAIPGALLPQRGLNAAKVDDYLAAHPliGPWLDELQAFDVFSSFWFTA
IYVLLFVSLVGCLAPRTIEHARSLRATPVAAPRNLARLPKHAHARLAGEPAALAATITGRLRGWRSITR
QQGDSVEVSAEKGYLREFGNLVFHFALLGLLVAVAVGKLFGYEGNVIVIADGGPGFCSASPAAFDSF
RAGNTVDGTSLHPICVRVNNFQAHYLPSGQATSFAADIDYQADPATADLIANSWRPYRLQVNHPLRV
GGDRVYLQGHGYAPTFTVTFPDGQTRTSTVQWRPDNPQTLLSAGVVRIDPPAGSYPNPDERRKHQI
AIQGLLAPTEQLDGTLLSSRFPALNAPAVAIDIYRGDTGLDSGRPQSLFTLDHRLIEQGRLVKEKRVNL
RAGQQVRIDQGPAAGTVVRFDGAVPFVNLQVSHDPGQSWVLVFAITMMAGLLVSLLVRRRRVWARI
TPTTAGTVNVELGGLTRTDNSGWGAEFERLTGRLLAGFEARSPDMAEAAAGTGRDVD >Rv0667 rpoB [beta] subunit of RNA polymerase TB.seq 759805:763320 MW:129220
SEQ ID NO:176
LADSRQSKTAASPSPSRPQSSSNNSVPGAPNRVSFAKLREPLEVPGLLDVQTDSFEWLIGSPRWRE
SAAERGDVNPVGGLEEVLYELSPIEDFSGSMSLSFSDPRFDDVKAPVDECKDKDMTYAAPLFVTAEF
INNNTGEIKSQTVFMGDFPMMTEKGTFIINGTERVVVSQLVRSPGVYFDETDKSTDKTLHSVKVIPSR
GAWLEFDVDKRDTVGVRIDRKRRQPVTVLLKALGWTSEQIVERFGFSEIMRSTLEKDNTVGTDEALL
DIYRKLRPGEPPTKESAQTLLENLFFKEKRYDLARVGRYKVNKKLGLHVGEPITSSTLTEEDVVATIEY
LVRLHEGQTTMTVPGGVEVPVETDDIDHFGNRRLRTVGELIQNQIRVGMSRMERVVRERMTTQDVE
AITPQTLINIRPVVAAIKEFFGTSQLSQFMDQNNPLSGLTHKRRLSALGPGGLSRERAGLEVRDVHPS
HYGRMCPIETPEGPNIGLIGSLSVYARVNPFGFIETPYRKVVDGVVSDEIVYLTADEEDRHVVAQANS
PIDADGRFVEPRVLVRRKAGEVEYVPSSEVDYMDVSPRQMVSVATAMIPFLEHDDANRALMGANMQ
RQAVPLVRSEAPLVGTGMELRAAIDAGDVVVAEESGVIEEVSADYITVMHDNGTRRTYRMRKFARSN
HGTCANQCPIVDAGDRVEAGQVIADGPCTDDGEMALGKNLLVAIMPWEGHNYEDAIILSNRLVEEDV
LTSIHIEEHEIDARDTKLGAEEITRDIPNISDEVLADLDERGIVRIGAEVRDGDILVGKVTPKGETELTPE
ERLLRAIFGEKAREVRDTSLKVPHGESGKVIGIRVFSREDEDELPAGVNELVRVYVAQKRKISDGDKL
AGRHGNKGVIGKILPVEDMPFLADGTPVDIILNTHGVPRRMNIGQILETHLGWCAHSGWKVDAAKGV
PDWAARLPDELLEAQPNAIVSTPVFDGAQEAELQGLLSCTLPNRDGDVLVDADGKAMLFDGRSGEP
FPYPVTVGYMYIMKLHHLVDDKIHARSTGPYSMITQQPLGGKAQFGGQRFGEMECWAMQAYGAAY
TLQELLTIKSDDTVGRVKVYEAIVKGENIPEPGIPESFKVLLKELQSLCLNVEVLSSDGAAIELREGEDE
DLERAAANLGINLSRNESASVEDLA >Rv0668 rpoC [beta]' subunit of RNA polymerase TB.seq 763368:767315 MW:146740
SEQ ID NO:177
VLDVNFFDELRIGLATAEDIRQWSYGEVKKPETINYRTLKPEKDGLFCEKIFGPTRDWECYCGKYKRV
RFKGIICERCGVEVTRAKVRRERMGHIELAAPVTHIWYFKGVPSRLGYLLDLAPKDLEKIIYFAAYVITS
VDEEMRHNELSTLEAEMAVERKAVEDQRDGELEARAQKLEADLAELEAEGAKADARRKVRDGGER
EMRQIRDRAQRELDRLEDIWSTFTKLAPKQLIVDENLYRELVDRYGEYFTGAMGAESIQKLIENFDIDA
EAESLRDVIRNGKGQKKLRALKRLKVVAAFQQSGNSPMGMVLDAVPVIPPELRPMVQLDGGRFATS
DLNDLYRRVINRNNRLKRLIDLGAPEIIVNNEKRMLQESVDALFDNGRRGRPVTGPGNRPLKSLSDLL
KGKQGRFRQNLLGKRVDYSGRSVIVVGPQLKLHQCGLPKLMALELFKPFVMKRLVDLNHAQNIKSAK
RMVERQRPQVWDVLEEVIAEHPVLLNRAPTLHRLGIQAFEPMLVEGKAIQLHPLVCEAFNADFDGDQ
MAVHLPLSAEAQAEARILMLSSNNILSPASGRPLAMPRLDMVTGLYYLTTEVPGDTGEYQPASGDHP TABLE 4-continued ETGVYSSPAEAIMAADRGVLSVRAKIKVRLTQLRPPVEIEAELFGHSGWQPGDAWMAETTLGRVMF
NELLPLGYPFVNKQMHKKVQAAIINDLAERYPMIVVAQTVDKLKDAGFYWATRSGVTVSMADVLVPP
RKKEILDHYEERADKVEKQFQRGALNHDERNEALVEIWKEATDEVGQALREHYPDDNPIITIVDSGAT
GNFTQTRTLAGMKGLVTNPKGEFIPRPVKSSFREGLTVLEYFINTHGARKGLADTALRTADSGYLTRR
LVDVSQDVIVREHDCQTERGIVVELAERAPDGTLIRDPYIETSAYARTLGTDAVDEAGNVIVERGQDL
GDPEIDALLAAGITQVKVRSVLTCATSTGVCATCYGRSMATGKLVDIGEAVGIVAAQSIGEPGTQLTM
RTFHQGGVGEDITGGLPRVQELFEARVPRGKAPIADVTGRVRLEDGERFYKITIVPDDGGEEVVYDKI
SKRQRLRVFKHEDGSERVLSDGDHVEVGQQLMEGSADPHEVLRVQGPREVQIHLVREVQEVYRAQ
GVSIHDKHIEVIVRQMLRRVTIIDSGSTEFLPGSLIDRAEFEAENRRVVAEGGEPAAGRPVLMGITKAS
LATDSWLSAASFQETTRVLTDAAINCRSDKLNGLKENVIIGKLIPAGTGINRYRNIAVQPTEEARAAAYT
IPSYEDQYYSPDFGAATGAAVPLDDYGYSDYR >Rv0711 atsA TB.seq 806333:808693 MW:86216 SEQ ID NO:178
MAPEATEAFNGTIELDIRDSEPDWGPYAAPVAPEHSPNILYLVWDDVGIATWDCFGGLVEMPAMTRV
AERGVRLSQFHTTALCSPTRASLLTGRNATTVGMATIEEFTDGFPNCNGRIPADTALLPEVLAEHGYN
TYCVGKWHLTPLEESNMASTKRHWPTSRGFERFYGFLGGETDQWYPDLVYDNHPVSPPGTPEGG
YHLSKDIADKTIEFIRDAKVIAPDKPWFSYVCPGAGHAPHHVFKEWADRYAGRFDMGYERYREIVLE
RQKALGIVPPDTELSPINPYLDVPGPNGETWPLQDTVRPWDSLSDEEKKLFCRMAEVFAGFLSYTDA
QIGRILDYLEESGQLDNTIIVVISDNGASGEGGPNGSVNEGKFFNGYIDTVAESMKLFDHLGGPQTYN
HYPIGWAMAFNTPYKLFKRYASHEGGIADPAIISWPNGIAAHGEIRDNYVNVSDITPTVYDLLGMTPP
GTVKGIPQKPMDGVSFIAALADFAADTGKTTQFYTMLGTRGIWHEGWFANTIHAATPAGWSNFNAD
RWELFHIAADRSQCHDLAAEHPDKLEELKALWFSEAAKYNGLPLADLNLLETMTRSRPYLVSERASY
VYYPDCADVGIGAAVEIRGRSFAVLADVTIDTTGAEGVLFKHGGAHGGHVLFVRDGRLHYVYNFLGE
RQQLVSSSGPVPSGRHLLGVRYLRTGTVPNSHTPVGDLELFFDENLVGALTNVLTHPGTFGLAGAAI
SVGRNGGSAVSSHYEAPFAFTGGTITQVTVDVSGRPFEDVESDLALAFSRD >Rv0764c - lanosterol 14-demethylase cytochrome P450 TB.seq 856683:858035 MW:50879
SEQ ID NO:179
MSAVALPRVSGGHDEHGHLEEFRTDPIGLMQRVRDECGDVGTFQLAGKQVVLLSGSHANEFFFRA
GDDDLDQAKAYPFMTPIFGEGVVFDASPERRKEMLHNAALRGEQMKGHAATIEDQVRRMIADWGE
AGEIDLLDFFAELTIYTSSACLIGKKFRDQLDGRFAKLYHELERGTDPLAYVDPYLPIESFRRRDEARN
GLVALVADIMNGRIANPPTDKSDRDMLDVLIAVKAETGTPRFSADEITGMFISMMFAGHHTSSGTASW
TLIELMRHRDAYAAVIDELDELYGDGRSVSFHALRQIPQLENVLKETLRLHPPLIILMRVAKGEFEVQG
HRIHEGDLVAASPAISNRIPEDFPDPHDFVPARYEQPRQEDLLNRWTWIPFGAGRHRCVGAAFAIMQI
KAIFSVLLREYEFEMAQPPESYRNDHSKMVVQLAQPACVRYRRRTGV >Rv0861c- DNA helicase TB.seq 958524:960149 MW:59773 SEQ ID NO:180
VQSDKTVLLEVDHELAGAARAAIAPFAELERAPEHVHTYRITPLALWNARAAGHDAEQVVDALVSYS
RYAVPQPLLVDIVDTMARYGRLQLVKNPAHGLTLVSLDRAVLEEVLRNKKIAPMLGARIDDDTVVVHP
SERGRVKQLLLKIGWPAEDLAGYVDGEAHPISLHQEGWQLRDYQRLAADSFWAGGSGVVVLPCGA
GKTLVGAAAMAKAGATTLILVTNIVAARQWKRELVARTSLTENEIGEFSGERKEIRPVTISTYQMITRR
TKGEYRHLELFDSRDWGLIIYDEVHLLPAPVFRMTADLQSKRRLGLTATLIREDGREGDVFSLIGPKR
YDAPWKDIEAQGWIAPAECVEVRVTMTDSERMMYATAEPEERYRICSTVHTKIAVVKSILAKHPDEQ
TLVIGAYLDQLDELGAELGAPVIQGSTRTSEREALFDAFRRGEVATLVVSKVANFSIDLPEAAVAVQVS
GTFGSRQEEAQRLGRILRPKADGGGAIFYSVVARDSLDAEYAAHRQRFLAEQGYGYIIRDADDLLGP
AI >Rv0904c accD3 TB.seq 1006694:1008178 MW:51741 SEQ ID NO:181
VSRITTDQLRHAVLDRGSFVSWDSEPLAVPVADSYARELAAARAATGADESVQTGEGRVFGRRVAV
VACEFDFLGGSIGVAAAERITAAVERATAERLPLLASPSSGGTRMQEGTVAFLQMVKIAAAIQLHNQA
RLPYLVYLRHPTTGGVFASWGSLGHLTVAEPGALIGFLGPRVYELLYGDPFPSGVQTAENLRRHGIID
GVVALDRLRPMLDRALTVLIDAPEPLPAPQTPAPVPDVPTWDSVVASRRPDRPGVRQLLRHGATDR
VLLSGTDQGEAATTLLALARFGGQPTVVLGQQRAVGGGGSTVGPAALREARRGMALAAELCLPLVL
VIDAAGPALSAAAEQGGLAGQIAHCLAELVTLDTPTVSILLGQGSGGPALAMLPADRVLAALHGWLAP
LPPEGASAIVFRDTAHAAELAAAQGIRSADLLKSGIVDTIVPEYPDAADEPIEFALRLSNAIAAEVHALR
KIPAPERLATRLQRYRRIGLPRD >Rv0983 - TB.seq 1099064:1100455 MW:46454 SEQ ID NO:182
MAKLARVVGLVQEEQPSDMTNHPRYSPPPQQPGTPGYAQGQQQTYSQQFDWRYPPSPPPQPTQY
RQPYEALGGTRPGLIPGVIPTMTPPPGMVRQRPRAGMLAIGAVTIAVVSAGIGGAAASLVGFNRAPA
GPSGGPVAASAAPSIPAANMPPGSVEQVAAKVVPSVVMLETDLGRQSEEGSGIILSAEGLILTNNHVI
AAAAKPPLGSPPPKTTVTFSDGRTAPFTVVGADPTSDIAVVRVQGVSGLTPISLGSSSDLRVGQPVLA
IGSPLGLEGTVTTGIVSALNRPVSTTGEAGNQNTVLDAIQTDAAINPGNSGGALVNMNAQLVGVNSAI
ATLGADSADAQSGSIGLGFAIPVDQAKRIADELISTGKASHASLGVQVTNDKDTLGAKIVEVVAGGAA
ANAGVPKGVVVTKVDDRPINSADALVAAVRSKAPGATVALTFQDPSGGSRTVQVTLGKAEQ >Rv1008 - Similar to *E. coli* protein YcfH TB.seq 1127087:1127878 MW:29066 SEQ ID NO:183
LVDAHTHLDACGARDADTVRSLVERAAAAGVTAVVTVADDLESARWVTRAAEWDRRVYAAVALHPT
RADALTDAARAELERLVAHPRVVAVGETGIDMYWPGRLDGCAEPHVQREAFAWHIDLAKRTGKPLM
IHNRQADRDVLDVLRAEGAPDTVILHCFSSDAAMARTCVDAGWLLSLSGTVSFRTARELREAVPLMP
VEQLLVETDAPYLTPHPHRGLANEPYCLPYTVRALAELVNRRPEEVALITTSNARRAYGLGWMRQ >Rv1009 - lipoprotein, similar to various other MTB proteins TB.seq 1128089:1129174 MW:38079
SEQ ID NO:184
MLRLVVGALLLVLAFAGGYAVAACKTVTLTVDGTAMRVTTMKSRVIDIVEENGFSVDDRDDLYPAAG
VQVHDADTIVLRRSRPLQISLDGHDAKQVWTTASTVDEALAQLAMTDTAPAAASRASRVPLSGMALP
VVSAKTVQLNDGGLVRTVHLPAPNVAGLLSAAGVPLLQSDHVVPAATAPIVEGMQIQVTRNRIKKVTE
RLPLPPNARRVEDPEMNMSREVVEDPGVPGTQDVTFAVAEVNGVETGRLPVANVVVTPAHEAVVR
VGTKPGTEVPPVIDGSIWDAIAGCEAGGNWAINTGNGYYGGVQFDQGTWEANGGLRYAPRADLAT TABLE 4-continued

REEQIAVAEVTRLRQGWGAWPVCAARAGAR

>Rv1010 ksgA 16S rRNA dimethyltransferase TB.seq 1129150:1130100 MW:34647
SEQ ID NO:185
MCCTSGCALTIRLLGRTEIRRLAKELDFRPRKSLGQNFVHDANTVRRVVMSGVSRSDLVLEVGPGL
GSLTLALLDRGATVTAVEIDPLLASRLQQTVAEHSHSEVHRLTVVNRDVLALRREDLAAAPTAVVANL
PYNVAVPALLHLLVEFPSIRVVTVMVQAEVAERLAAEPGSKEYGVPSVKLRFFGRVRRCGMVSPTVF
WPIPRVYSGLVRIDRYETSPWPTDDAFRRRVFELVDIAFAQRRKTSRNAFVQWAGSGSESANRLLAA
SIDPARRGETLSIDDFVRLLRRSGGSDEATSTGRDARAPDISGHASAS >Rv1011 - Similar to *E. coli* protein YcbH TB.seq 1130189:1131106 MW:31350
SEQ ID NO:186
VPTGSVTVRVPGKVNLYLAVGDRREDGYHELTTVFHAVSLVDEVTVRNADVLSLELVGEGADQLPTD
ERNLAWQAAELMAEHVGRAPDVSIMIDKSIPVAGGMAGGSADAAAVLVAMNSLWELNVPRRDLRML
AARLGSDVPFALHGGTALGTGRGEELATVLSRNTFHWVLAFADSGLLTSAVYNELDRLREVGDPPRL
GEPGPVLAALAAGDPDQLAPLLGNEMQAAAVSLDPALARALRAGVEAGALAGIVSGSGPTCAFLCTS
ASSAIDVGAQLSGAGVCRTVRVATGPVPGARVVSAPTEV >Rv1106c - cholesterol dehydrogenase TB.seq 1232845:1233954 MW:40743 SEQ ID NO:187
MLRRMGDASLTTELGRVLVTGGAGFVGANLVTTLLDRGHWVRSFDRAPSLLPAHPQLEVLQGDITD
ADVCAAAVDGIDTIFHTAAIIELMGGASVTDEYRQRSFAVNVGGTENLLHAGQRAGVQRFVYTSSNS
VVMGGQNIAGGDETLPYTDRFNDLYTETKVVAERFVLAQNGVDGMLTCAIRPSGIWGNGDQTMFRK
LFESVLKGHVKVLVGRKSARLDNSYVHNLIHGFILAAAHLVPDGTAPGQAYFINDAEPINMFEFARPVL
EACGQRWPKMRISGPAVRWVMTGWQRLHFRFGFPAPLLEPLAVERLYLDNYFSIAKARRDLGYEPL
FTTQQALTECLPYYVSLFEQMKNEARAEKTAATVKP >Rv1110 lytB2 TB.seq 1236183:1237187 MW:36298 SEQ ID NO:188
MVPTVDMGIPGASVSSRSVADRPNRKRVLLAEPRGYCAGVDRAVETVERALQKHGPPVYVRHEIVH
NRHVVDTLAKAGAVFVEETEQVPEGAIVVFSAHGVAPTVHVSASERNLQVIDATCPLVTKVHNEARR
FARDDYDILLIGHEGHEEVVGTAGEAPDHVQLVDGVDAVDQVTVRDEDKVVWLSQTTLSVDETMEIV
GRLRRRFPKLQDPPSDDICYATQNRQVAVKAMAPECELVIVVGSRNSSNSVRLVEVALGAGARAAH
LVDWADDIDSAWLDGVTTVGVTSGASVPEVLVRGVLERLAECGYDIVQPVTTANETLVFALPRELRS
PR >Rv1216c - TB.seq 1359473:1360144 MW:24863 SEQ ID NO:189
MHIGLKIFIWGVLGLVVFGALLFGPAGTFDYWQAWVFLAAFVSTTIGPTIYLARNDPAALQRRMRSGP
LAEGRTIQKFIVIGAFLGFFAMMVLSACDHRYGWSSVPAAVCVIGDVLVMTGLGIAMLVVIQNRYAAS
TVRVEAGQILASDGLYKIVRHPMYAGNVVMMTGIPLALGSYWAMFILVPGTLVLVFRILDEEKLLTQEL
SGYREYRQLVRYRLVPYVW >Rv1223 htrA TB.seq 1365810:1367456 MW:56547 SEQ ID NO:190
VSHLSQRMAGLLRVHGEWSRSVDTRVDTDNAMPARFSAQIQNEDEVTSDQGNNGGPNGGGRLAP
RPVFRPPVDPASRQAFGRPSGVQGSFVAERVRPQKYQDQSDFTPNDQLADPVLQEAFGRPFAGAE
SLQRHPIDAGALAAEKDGAGPDEPDDPWRDPAAAAALGTPALAAPAPHGALAGSGKLGVRDVLFGG
KVSYLALGILVAIALVIGGIGGVIGRKTAEVVDAFTTSKVTLSTTGNAQEPAGRFTKVAAAVADSVVTIE
SVSDQEGMQGSGVIVDGRGYIVTNNHVISEAANNPSQFKTTVVFNDGKEVPANLVGRDPKTDLAVLK
VDNVDNLTVARLGDSSKVRVGDEVLAVGAPLGLRSTVTQGIVSALHRPVPLSGEGSDTDTVIDAIQTD
ASINHGNSGGPLIDMDAQVIGINTAGKSLSDSASGLGFAIPVNEMKLVANSLIKDGKIVHPTLGISTRSV
SNAIASGAQVANVKAGSPAQKGGILENDVIVKVGNRAVADSDEFVVAVRQLAIGQDAPIEVVREGRH
VTLTVKPDPDST >Rv1224 - TB.seq 1367461:1367853 MW:14083 SEQ ID NO:191
VFANIGWWEMLVLVMVGLVVLGPERLPGAIRWAASALRQARDYLSGVTSQLREDIGPEFDDLRGHL
GELQKLRGMTPRAALTKHLLDGDDSLFTGDFDRPTPKKPDAAGSAGPDATEQIGAGPIPFDSDAT >Rv1229c mrp similar to MRP/NBP35 ATP-binding proteins TB.seq 1371778:1372947 MW:41064
SEQ ID NO:192
MPSRLHSAVMSGTRDGDLNAAIRTALGKVIDPELRRPITELGMVKSIDTGPDGSVHVEIYLTIAGCPKK
SEITERVTRAVADVPGTSAVRVSLDVMSDEQRTELRKQLRGDTREPVIPFAQPDSLTRVYAVASGKG
GVGKSTVTVNLAAAMAVRGLSIGVLDADIHGHSIPRMMGTTDRPTQVESMILPPIAHQVKVISIAQFTQ
GNTPVVWRGPMLHRALQQFLADVYWGDLDVLLLDLPPGTGDVAISVAQLIPNAELLVVTTPQLAAAE
VAERAGSIALQTRQRIVGVVENMSGLTLPDGTTMQVGEGGGRLVAERLSRAVGADVPLLGQIPLDP
ALVAAGDSGVPLVLSSPDSAIGKELHSIADGLSTRRRGLAGMSLGLDPTRR >Rv1239c corA magnesium and cobalt transport protein TB.seq 1381943:1383040 MW:41470
SEQ ID NO:193
VFPGFDALPEVLRPVARPQPPNAHPVAQPPAQALVDCGVYVCGQRLPGKYTYAAALREVREIELTG
QEAFVWIGLHEPDENQMQDVADVFGLHPLAVEDAVHAHQRPKLERYDETLFLVLKTVNYVPHESVV
LAREIVKTGEIMIFVGKDFVVTVRHGEHGGLSEVRKRMDADPEHLRLGPYAVMHAIADYVVDHYLEVT
NLMETDIDSIEEVAFAPGRKLDIEPIYLLKREVVELRRCVNPLSTAFQRMQTESKDLISKEVRRYLRDV
ADHQTEAADQIASYDDMLNSLVQAALARVGMQQNMDMRKISAWAGIIAVPTMIAGIYGMNFHFMPEL
DSRWGYPTVIGGMLICLFLYHVFRNRNWL >Rv1279 - TB.seq 1430060:1431643 MW:57332 SEQ ID NO:194
MDTQSDYVVVGTGSAGAVVASRLSTDPATTVVALEAGPRDKNRFIGVPAAFSKLFRSEIDWDYLTEP
QPELDGREIYWPRGKVLGGSSSMNAMMWVRGFASDYDEWAARAGPRWSYADVLGYFRRIENVTA
AWHFVSGDDSGVTGPLHISRQRSPRSVTAAWLAAARECGFAAARPNSPRPEGFCETVVTQRRGAR
FSTADAYLKPAMRRKNLRVLTGATATRVVIDGDRAVGVEYQSDGQTRIVYARREVVLCAGAVNSPQL
LMLSGIGDRDHLAEHDIDTVYHAPEVGCNLLDHLVTVLGFDVEKDSLFAAEKPGQLISYLLRRRGMLT TABLE 4-continued SNVGEAYGFVRSRPELKLPDLELIFAPAPFYDEALVPPAGHGVVFGPILVAPQSRGQITLRSADPHAK
PVIEPRYLSDLGGVDRAAMMAGLRICARIAQARPLRDLLGSIARPRNSTELDEATLELALATCSHTLYH
PMGTCRMGSDEASVVDPQLRVRGVDGLRVADASVMPSTVRGHTHAPSVLIGEKAADLIRS >Rv1294 thrA homoserine dehydrogenase TB.seq 1449373:1450695 MW:45522 SEQ ID NO:195
VPGDEKPVGVAVLGLGNVGSEVVRIIENSAEDLAARVGAPLVLRGIGVRRVTTDRGVPIELLTDDIEEL
VAREDVDIVVEVMGPVEPSRKAILGALERGKSVVTANKALLATSTGELAQAAESAHVDLYFEAAVAGA
IPVIRPLTQSLAGDTVLRVAGIVNGTTNYILSAMDSTGADYASALADASALGYAEADPTADVEGYDAA
AKAAILASIAFHTRVTADDVYREGITKVTPADFGSAHALGCTIKLLSICERITTDEGSQRVSARVYPALV
PLSHPLAAVNGAFNAVVVEAEAAGRLMFYGQGAGGAPTASAVTGDLVMAARNRVLGSRGPRESKY
AQLPVAPMGFIETRYYVSMNVADKPGVLSAVAAEFAKREVSIAEVRQEGVVDEGGRRVGARIVVVTH
LATDAALSETVDALDDLDVVQGVSSVIRLEGTGL >Rv1323 fadA4 acetyl-CoA C-acetyltransferase (aka thiL) TB.seq 1485860:1487026 MW:40049 SEQ ID NO:196
VIVAGARTPIGKLMGSLKDFSASELGAIAIKGALEKANVPASLVEYVIMGQVLTAGAGQMPARQAAVA
AGIGWDVPALTINKMCLSGIDAIALADQLIRAREFDVVVAGGQESMTKAPHLLMNSRSGYKYGDVTVL
DHMAYDGLHDVFTDQPMGALTEQRNDVDMFTRSEQDEYAAASHQKAAAAWKDGVFADEVIPVNIP
QRTGDPLQFTEDEGIRANTTAAALAGLKPAFRGDGTITAGSASQISDGAAAVVVMNQEKAQELGLTW
LAEIGAHGVVAGPDSTLQSQPANAINKALDREGISVDQLDVVEINEAFAAVALASIRELGLNPQIVNVN
GGAIAVGHPLGMSGTRITLHAALQLARRGSGVGVAALCGAGGQGDALILRAG >Rv1389 gmk putative guanylate kinase TB.seq 1564399:1565022 MW:22064 SEQ ID NO:197
VSVGEGPDTKPTARGQPAAVGRVVVLSGPSAVGKSTVVRCLRERIPNLHFSVSATTRAPRPGEVDG
VDYHFIDPTRFQQLIDQGELLEWAEIHGGLHRSGTLAQPVRAAAATGVPVLIEVDLAGARAIKKTMPE
AVTVFLAPPSWQDLQARLIGRGTETADVIQRRLDTARIELAAQGDFDKVVVNRRLESACAELVSLLVG
TAPGSP >Rv1407 fmu similar to Fmu protein TB.seq 1583099:1584469 MW:48494 SEQ ID NO:198
MTPRSRGPRRRPLDPARRAAFETLRAVSARDAYANLVLPALLAQRGIGGRDAAFATELTYGTCRAR
GLLDAVIGAAAERSPQAIDPVLLDLLRLGTYQLLRTRVDAHAAVSTTVEQAGIEFDSARAGFVNGVLR
TIAGRDERSWVGELAPDAQNDPIGHAAFVHAHPRWIAQAFADALGMAAGELEAVLASDDERPAVHLA
ARPGVLTAGELARAVRGTVGRYSPFAVYLPRGDPGRLAPVRDGQALVQDEGSQLVARALTLAPVDG
DTGRWLDLCAGPGGKTALLAGLGLQCAARVTAVEPSPHRADLVAQNTRGLPVELLRVDGRHTDLDP
GFDRVLVDAPCTGLGALRRRPEARWRRQPADVAALAKLQRELLSAAIALTRPGGVVLYATCSPHLAE
TVGAVADALRRHPVHALDTRPLFEPVIAGLGEGPHVQLWPHRHGTDAMFAAALRRLT >Rv1409 ribG riboflavin biosynthesis TB.seq 1585192:1586208 MW:35367 SEQ ID NO:199
MNVEQVKSIDEAMGLAIEHSYQVKGTTYPKPPVGAVIVDPNGRIVGAGGTEPAGGDHAEVVALRRAG
GLAAGAIVVVTMEPCNHYGKTPPCVNALIEARVGTVVYAVADPNGIAGGGAGRLSAAGLQVRSGVLA
EQVAAGPLREWLHKQRTGLPHVTWKYATSIDGRSAAADGSSQWISSEMRLDLHRRRAIADAILVGT
GTVLADDPALTARLADGSLAPQQPLRVWGKRDIPPEARVLNDEARTMMIRTHEPMEVLRALSDRTD
VLLEGGPTLAGAFLRAGAINRILAYVAPILLGGPVTAVDDVGVSNITNALRWQFDSVEKVGPDLLLSLV
AR >Rv1440 secG TB.seq 1617715:1618065 MW:12140 SEQ ID NO:200
VAGVTAAVSARLKADEARRPGFYAAGSGPLPQVRGSTLPVMELALQITLIVTSVLVVLLVLLHRAKGG
GLSTLFGGGVQSSLSGSTVVEKNLDRLTLFVTGIWLVSIIGVALLIKYR >Rv1484 inhA TB.seq 1674200:1675006 MW:28529 SEQ ID NO:201
MTGLLDGKRILVSGIITDSSIAFHIARVAQEQGAQLVLTGFDRLRLIQRITDRLPAKAPLLELDVQNEEH
LASLAGRVTEAIGAGNKLDGVVHSIGFMPQTGMGINPFFDAPYADVSKGIHISAYSYASMAKALLPIM
NPGGSIVGMDFDPSRAMPAYNWMTVAKSALESVNRFVAREAGKYGVRSNLVAAGPIRTLAMSAIVG
GALGEEAGAQIQLLEEGWDQRAPIGWNMKDATPVAKTVCALLSDWLPATTGDIIYADGGAHTQLL >Rv1617 pykA pyruvate kinase TB.seq 1816187:1817602 MW:50668 SEQ ID NO:202
VTRRGKIVCTLGPATQRDDLVRALVEAGMDVARMNFSHGDYDDHKVAYERVRVASDATGRAVGVL
ADLQGPKIRLGRFASGATHWAEGETVRITVGACEGSHDRVSTTYKRLAQDAVAGDRVLVDDGKVAL
VVDAVEGDDVVCTVVEGGPVSDNKGISLPGMNVTAPALSEKDIEDLTFALNLGVDMVALSFVRSPAD
VELVHEVMDRIGRRVPVIAKLEKPEAIDNLEAIVLAFDAVMVARGDLGVELPLEEVPLVQKRAIQMARE
NAKPVIVATQMLDSMIENSRPTRAEASDVANAVLDGADALMLSGETSVGKYPLAAVRTMSRIICAVEE
NSTAAPPLTHFPRTKRGVISYAARDIGERLDAKALVAFTQSGDTVRRLARLHTPLPLLAFTAWPEVRS
QLAMTWGTETFIVPKMQSTDGMIRQVDKSLLELARYKRGDLVVIVAGAPPGTVGSTNLIHVHRIGEDD
V >Rv1630 rpsA 30S ribosomal protein S1 TB.seq 1833540:1834982 MW:53203 SEQ ID NO:203
MPSPTVTSPQVAVNDIGSSEDFLAAIDKTIKYFNDGDIVEGTIVKVDRDEVLLDIGYKTEGVIPARELSIK
HDVDPNEVVSVGDEVEALVLTKEDKEGRLILSKKRAQYERAWGTIEALKEKDEAVKGTVIEVVKGGLI
LDIGLRGFLPASLVEMRRVRDLQPYIGKEIEAKIIELDKNRNNVVLSRRAWLEQTQSEVRSEFLNNLQK
GTIRKGVVSSIVNFGAFVDLGGVDGLVHVSELSWKHIDHPSEVVQVGDEVTVEVLDVDMDRERVSLS
LKATQEDPWRHFARTHAIGQIVPGKVTKLVPFGAFVRVEEGIEGLVHISELAERHVEVPDQVVAVGDD
AMVKVIDIDLERRRISLSLKQANEDYTEEFDPAKYGMADSYDEQGNYIFPEGFDAETNEWLEGFEKQ
RAEWEARYAEAERRHKMHTAQMEKFAAAEAAGRGADDQSSASSAPSEKTAGGSLASDAQLAALRE
KLAGSA >Rv1631 - TB.seq 1835011:1836231 MW:44669 SEQ ID NO:204
MLRIGLTGGIGAGKSLLSTTFSQCGGIVVDGDVLAREVVQPGTEGLASLVDAFGRDILLADGALDRQA
LAAKAFRDDESRGVLNGIVHPLVARRRSEIIAAVSGDAVVVEDIPLLVESGMAPLFPLVVVVHADVELR
VRRLVEQRGMAEADARARIAAQASDQQRRAVADVWLDNSGSPEDLVRRARDVWNTRVQPFAHNL TABLE 4-continued AQRQIARAPARLVPADPSWPDQARRIVNRLKIACGHKALRVDHIGSTAVSGFPDFLAKDVIDIQVTVE
SLDVADELAEPLLAAGYPRLEHITQDTEKTDARSTVGRYDHTDSAALWHKRVHASADPGRPTNVHLR
VHGWPNQQFALLFVDWLAANPGAREDYLTVKCDADRRADGELARYVTAKEPWFLDAYQRAWEWA
DAVHWRP >Rv1706c - TB.seq 1932695:1933876 MW:39779 SEQ ID NO:205
MTLDVPVNQGHVPPGSVACCLVGVTAVADGIAGHSLSNFGALPPEINSGRMYSGPGSGPLMAAAAA
WDGLAAELSSAATGYGAAISELTNMRWWSGPASDSMVAAVLPFVGWLSTTATLAEQAAMQARAAA
AAFEAAFAMTVPPPAIAANRTLLMTLVDTNWFGQNTPAIATTESQYAEMWAQDAAAMYGYASAAAP
ATVLTPFAPPPQTTNATGLVGHATAVAALRGQHSWAAAIPWSDIQKYWMMFLGALATAEGFIYDSG
GLTLNALQFVGGMLWSTALAEAGAAEAAAGAGGAAGWSAWSQLGAGPVAASATLAAKIGPMSVPP
GWSAPPATPQAQTVARSIPGIRSAAEAAETSVLLRGAPTPGRSRAAHMGRRYGRRLTVMADRPNVG >Rv1745c - similar to Q46822 ORF_O182 TB.seq 1971381:1971989 MW:22490 SEQ ID NO:206
MTRSYRPAPPIERVVLLNDRGDATGVADKATVHTGDTPLHLAFSSYVFDLHDQLLITRRAATKRTWP
AVWTNSCCGHPLPGESLPGAIRRRLAAELGLTPDRVDLILPGFRYRAAMADGTVENEICPVYRVQVD
QQPRPNSDEVDAIRWLSWEQFVRDVTAGVIAPVSPWCRSQLGYLTKLGPCPAQWPVADDCRLPKA
AHGN >Rv1800 - TB.seq 2039451:2041415 MW:67068 SEQ ID NO:207
MLPNFAVLPPEVNSARVFAGAGSAPMLAAAAAWDDLASELHCAAMSFGSVTSGLVVGWWQGSASA
AMVDAAASYIGWLSTSAAHAEGMGLARAAVSVFEEALAATVHPAMVAANRAQVASLVASNLFGQN
APAIAALESLYECMWAQDAAAMAGYYVGASAVATQLASWLQRLQSIPGMSLDARLPSSAEAPMGV
VRAVNSAIAANAAAQTVGLVMGGSGTPIPSARYVELANALYMSGSVPGVIAQALFTPQGLYPVVVIK
NLTFDSSVAQGAVILESAIRQQIAAGNNVTVFGYSQSATISSLVMANLAASADPPSPDELSFTLIGNPN
NPNGGVATRFPGISFPSLGVTATGATPHNLYPTKIYTIEYDGVADFPRYPLNFVSTLNAIAGTYYVHSN
YFILTPEQIDAAVPLTNTVGPTMTQYYIIRTENLPLLEPLRSVPIVGNPLANLVQPNLKVIVNLGYGDPA
YGYSTSPPNVATPFGLFPEVSPVVIADALVAGTQQGIGDFAYDVSHLELPLPADGSTMPSTAPGSGT
PVPPLSIDSLIDDLQVANRNLANTISKVAATSYATVLPTADIANAALTIVPSYNIHLFLEGIQQALKGDPM
GLVNAVGYPLAADVALFTAAGGLQLLIIISAGRTIANDISAIVP >Rv1844c gnd 6-phosphogluconate dehydrogenase (Gram -) TB.seq 2093732:2095186 MW:51548 SEQ ID NO:208
MSSSESPAGIAQIGVTGLAVMGSNIARNFARHGYTVAVHNRSVAKTDALLKEHSSDGKFVRSETIPEF
LAALEKPRRVLIMVKAGEATDADAVINELADAMEPGDIIIDGGNALYTDTMRREKAMRERGLHFVGAG
ISGGEEGALNGPSIMPGGPAESYQSLGPLLEEISAHVDGVPCCTHIGPDGSGHFVKMVHNGIEYSDM
QLIGEAYQLMRDGLGLTAPAIAOVFTEWNNGDLDSYLVEITAEVLRQTDAKTGKPLVDVIVDRAEQKG
TGRWTVKSALDLGVPVTGIAEAVFARALSGSVGQRSAASGLASGKLGEQPADPATFTEDVRQALYA
SKIVAYAQGFNQIQAGSAEFGWDITPGDLATIWRGGCIIRAKFLNHIKEAFDASPNLASLIVAPYFRGA
VESAIDSWRRVVSTAAQLGIPTPGFSSALSYYDALRTARLPAALTQAQRDFFGAHTYGRIDEPGKFHT
LWSSDRTEVPV >Rv1900c lipJ TB.seq 2146246:2147631 MW:49685 SEQ ID NO:209
VAQAPHIHRTRYAKCGDMDIAYQVLGDGPTDLLVLPGPFVPIDSIDDEPSLYRFHRRLASFSRVIRLDH
RGVGLSSRLAAITTLGPKFWAQDAIAVMDAVGCEQATIFAPSFHAMNGLVLAADYPERVRSLIVVNGS
ARPLWAPDYPVGAQVRRADPFLTVALEPDAVERGFDVLSIVAPTVAGDDVFRAWWDLAGNRAGPP
SIARAVSKVIAEADVRDVLGHIEAPTLILHRVGSTYIPVGHGRYLAEHIAGSRLVELPGTDTLYWVGDT
GPMLDEIEEFITGVRGGADAERMLATIMFTDIVGSTQHAAALGDDRWRDLLDNHDTIVCHEIQRFGGR
EVNTAGDGFVATFTSPSAAIACADDIVDAVAALGIEVRIGIHAGEVEVRDASHGTDVAGVAVHIGARVC
ALAGPSEVLVSSTVRDIVAGSRHRFAERGEQELKGVPGRWRLCVLMRDDATRTR >Rv1967 - TB.seq 2210599:2211624 MW:36516 SEQ ID NO:210
MRENLGGVVVRLGVFLAVCLLTAFLLIAVFGEVRFGDGKTYYAEFANVSNLRTGKLVRIAGVEVGKVT
RISINPDATVRVQFTADNSVTLTRGTRAVIRYDNLFGDRYLALEEGAGGLAVLRPGHTIPLARTQPALD
LDALIGGFKPLFRALNPEQVNALSEQLLHAFAGQGPTIGSLLAQSAAVTNTLADRDRLIGQVITNLNVV
LGSLGAHTDRLDQAVTSLSALIHRLAQRKTDISNAVAYTNAMGSVADLLSQARAPLAKVVRETDRVA
GIAAADHDYLDNLLNTLPDKYQALVRQGMYGDFFAFYLCDVVLKVNGKGGQPVYIKLAGQDSGRCA
PK >Rv1975 - TB.seq 2218050:2218712 MW:23650 SEQ ID NO:211
MSRRASATCALSATTAVAIMAAPAARADDKRLNDGVVANVYTVQRQAGCTNDVTINPQLQLAAQWH
TLDLLNNRHLNDDTGSDGSTPQDRAHAAGFRGKVAETVAINPAVAISGIELINQWYYNPAFFAIMSDC
ANTQIGVWSENSPDRTVVVAVYGQPDRPSAMPPRGAVTGPPSPVAAQENVPIDPSPDYDASDEIEY
GINWLPWILRGVYPPPAMPPQ >Rv1981c nrdF ribonucleotide reductase small subunit TB.seq 2224221:2225186 MW:36591 SEQ ID NO:212
MTGKLVERVHAINWNRLLDAKDLQVWERLTGNFWLPEKIPLSNDLASWQTLSSTEQQTTIRVFTGLT
LLDTAQATVGAVAMIDDAVTPHEEAVLTNMAFMESVHAKSYSSIFSTLCSTKQIDDAFDWSEQNPYL
QRKAQIIVDYYRGDDALKRKASSVMLESFLFYSGFYLPMYWSSRGKLTNTADLIRLIIRDEAVHGYYIG
YKCQRGLADLTDAERADHREYTCELLHTLYANEIDYAHDLYDELGWTDDVLPYMRYNANKALANLG
YQPAFDRDTCQVNPAVRAALDPGAGENHDFFSGSGSSYVMGTHQPTTDTDWDF >Rv2092c helY helicase, Ski2 subfamily TB.seq 2349335:2352052 MW:99576 SEQ ID NO:213
VTELAELDRFTAELPFSLDDFQQRACSALERGHGVLVCAPTGAGKTVVGEFAVHLALAAGSKCFYTT
PLKALSNQKHTDLTARYGRDQIGLLTGDLSVNGNAPVVVMTTEVLRNMLYADSPALQGLSYVVMDE
VHFLADRMRGPVWEEVILQLPDDVRVVSLSATVSNAEEFGGWIQTVRGDTVVVDEHRPVPLWQHV
LVGKRMFDLFDYRIGEAEGQPQVNRELLRHIAHRREADRMADWQPRRRGSGRPGFYRPPGRPEVI
AKLDAEGLLPAITFVFSRAGCDAAVTQCLRSPLRLTSEEERARIAEVIDHRCGDLADSDLAVLGYYEW TABLE 4-continued REGLLRGLAAHHAGMLPAFRHTVEELFTAGLVKAVFATETLALGINMPARTVVLERLVKFNGEQHMP
LTPGEYTQLTGRAGRRGIDVEGHAVVIWHPEIEPSEVAGLASTRTFPLRSSFAPSYNMTINLVHRMGP
QQAHRLLEQSFAQYQADRSVVGLVRGIERGNRILGEIAAELGGSDAPILEYARLRARVSELERAQARA
SRLQRRQAATDALAALRRGDIITITHGRRGGLAVVLESARDRDDPRPLVLTEHRWAGRISSADYSGTT
PVGSMTLPKRVEHRQPRVRRDLASALRSAAAGLVIPAARRVSEAGGFHDPELESSREQLRRHPVHT
SPGLEDQIRQAERYLRIERDNAQLERKVAAATNSLARTFDRFVGLLTEREFIDGPATDPVVTDDGRLL
ARIYSESDLLVAECLRTGAWEGLKPAELAGVVSAVVYETRGGDGQGAPFGADVPTPRLRQALTQTS
RLSTTLRADEQAHRITPSREPDDGFVRVIYRWSRTGDLAAALAAADVNGSGSPLLAGDFVRWCRQV
LDLLDQVRNAAPNPELRATAKRAIGDIRRGVVAVDAG >Rv2101 helZ helicase, Snf2/Rad54 family TB.seq 2360238:2363276 MW:111632
SEQ ID NO:214
MLVLHGFWSNSGGMRLWAEDSDLLVKSPSQALRSARPHPFAAPADLIAGIHPGKPATAVLLLPSLRS
APLDSPELIRLAPRPAARTDPMLLAWTVPVVDLDPTAALAAFDQPAPDVRYGASVDYLAELAVFAREL
VERGRVLPQLRRDTHGAAACWRPVLQGRDVVAMTSLVSAMPPVCRAEVGGHDPHELATSALDAMV
DAAVRAALSPMDLLPPRRGRSKRHRAVEAWLTALTCPDGRFDAEPDELDALAEALRPWDDVGIGTV
GPARATFRLSEVETENEETPAGSLWRLEFLLQSTQDPSLLVPAEQAWNDDGSLRRWLDRPQELLLT
ELGRASRIFPELVPALRTACPSGLELDADGAYRFLSGTAAVLDEAGFGVLLPSWWDRRRKLGLVLSA
YTPVDGVVGKASKFGREQLVEFRWELAVGDDPLSEEEIAALTETKSPLIRLRGQWVALDTEQMRRGL
EFLERKPTGRKTTAEILALAASHPDDVDTPLEVTAVRADGWLGDLLAGAAAASLQPLDPPDGFTATLR
PYQQRGLAWLAFLSSLGLGSCLADDMGLGKTVQLLALETLESVQRHQDRGVGPTLLLCPMSLVGN
WPQEAARFAPNLRVYAHHGGARLHGEALRDHLERTDLVVSTYTTATRDIDELAEYEWNRVVLDEAQ
AVKNSLSRAAKAVRRLRAAHRVALTGTPMENRLAELWSIMDFLNPGLLGSSERFRTRYAIPIERHGHT
EPAERLRASTRPYILRRLKTDPAIIDDLPEKIEIKQYCQLTTEQASLYQAVVADMMEKIENTEGIERRGN
VLAAMAKLKQVCNHPAQLLHDRSPVGRRSGKVIRLEEILEEILAEGDRVLCFTQFTEFAELLVPHLAAR
FGRAARDIAYLHGGTPRKRRDEMVARFQSGDGPPIFLLSLKAGGTGLNLTAANHVVHLDRWWNPAV
ENQATDRAFRIGQRRTVQVRKFICTGTLEEKIDEMIEEKKALADLVVTDGEGWLTELSTRDLREVFAL
SEGAVGE >Rv2110c prcB proteasome [beta]-type subunit 2 TB.seq 2369727:2370599 MW:30274
SEQ ID NO:215
VTWPLPDRLSINSLSGTPAVDLSSFTDFLRRQAPELLPASISGGAPLAGGDAQLPHGTTIVALKYPGG
VVMAGDRRSTQGNMISGRDVRKVYITDDYTATGIAGTAAVAVEFARLYAVELEHYEKLEGVPLTFAG
KINRLAIMVRGNLAAAMQGLLALPLLAGYDIHASDPQSAGRIVSFDAAGGWNIEEEGYQAVGSGSLFA
KSSMKKLYSQVTDGDSGLRVAVEALYDAADDDSATGGPDLVRGIFPTAVIIDADGAVDVPESRIAELA
RAIIESRSGADTFGSDGGEK >Rv2118c - = B2126_C1_165 (83.6%) TB.seq 2377471:2378310 MW:30091 SEQ ID NO:216
VSATGPFSIGERVQLTDAKGRRYTMSLTPGAEFHTHRGSIAHDAVIGLEQGSVVKSSNGALFLVLRPL
LVDYVMSMPRGPQVIYPKDAAQIVHEGDIFPGARVLEAGAGSGALTLSLLRAVGPAGQVISYEQRAD
HAEHARRNVSGCYGQPPDNWRLVVSDLADSELPDGSVDRAVLDMLAPWEVLDAVSRLLVAGGVLM
VYVATVTQLSRIVEALRAKQCWTEPRAWETLQRGWNVVGLAVRPQHSMRGHTAFLVATRRLAPGA
VAPAPLGRKREGRDG >Rv2144c - TB.seq 2404166:2404519 MW:12028 SEQ ID NO:217
MLIIALVLALIGLLALVFAVVTSNQLVAWVCIGASVLGVALLIVDALRERQQGGADEADGAGETGVAEE
ADVDYPEEAPEESQAVDAGVIGSEEPSEEASEATEESAVSADRSDDSAK >Rv2146c - TB.seq 2405667:2405954 MW:10805 SEQ ID NO:218
LVVFFQILGFALFIFWLLLIARVVVEFIRSFSRDWRPTGVTVVILEIIMSITDPPVKVLRRLIPQLTIGAVRF
DLSIMVLLLVAFIGMQLAFGAAA >Rv2147c - TB.seq 2406119:2406841 MW:27630 SEQ ID NO:219
VNSHCSHTFITDNRSPRARRGHAMSTLHKVKAYFGMAPMEDYDDEYYDDRAPSRGYARPRFDDDY
GRYDGRDYDDARSDSRGDLRGEPADYPPPGYRGGYADEPRFRPREFDRAEMTRPRFGSWLRNST
RGALAMDPRRMAMMFEDGHPLSKITTLRPKDYSEARTIGERFRDGSPVIMDLVSMDNADAKRLVDF
AAGLAFALRGSFDKVATKVFLLSPADVDVSPEERRRIAETGFYAYQ >Rv2148c - TB.seq 2406841:2407614 MW:27694 SEQ ID NO:220
MAADLSAYPDRESELTHALAAMRSRLAAAAEAAGRNVGEIELLPITKFFPATDVAILFRLGCRSVGES
REQEASAKMAELNRLLAAAELGHSGGVHWHMVGRIQRNKAGSLARWAHTAHSVDSSRLVTALDRA
VVAALAEHRRGERLRVYVQVSLDGDGSRGGVDSTTPGAVDRICAQVQESEGLELVGLMGIPPLDWD
PDEAFDRLQSEHNRVRAMFPHAIGLSAGMSNDLEVAVKHGSTCVRVGTALLGPRRLRSP >Rv2150c ftsZ TB.seq 2408386:2409522 MW:38757 SEQ ID NO:221
MTPPHNYLAVIKVVGIGGGGVNAVNRMIEQGLKGVEFIAINTDAQALLMSDADVKLDVGRDSTRGLG
AGADPEVGRKAAEDAKDEIEELLRGADMVFVTAGEGGGTGTGGAPVVASIARKLGALTVGVVTRPF
SFEGKRRSNQAENGIAALRESCDTLIVIPNDRLLQMGDAAVSLMDAFRSADEVLLNGVQGITDLITTP
GLINVDFADVKGIMSGAGTALMGIGSARGEGRSLKAAEIAINSPLLEASMEGAQGVLMSIAGGSDLGL
FEINEAASLVQDAAHPDANIIFGTVIDDSLGDEVRVTVIAAGFDVSGPGRKPVMGETGGAHRIESAKA
GKLTSTLFEPVDAVSVPLHTNGATLSIGGDDDDVDVPPFMRR >Rv2152c murC TB.seq 2410639:2412120 MW:51146 SEQ ID NO:222
VSTEQLPPDLRRVHMVGIGGAGMSGIARILLDRGGLVSGSDAKESRGVHALRARGALIRIGHDASSL
DLLPGGATAVVTTHAAIPKTNPELVEARRRGIPVVLRPAVLAKLMAGRTTLMVTGTHGKTTTTSMLIVA
LQHCGLDPSFAVGGELGEAGTNAHHGSGDCFVAEADESDGSLLQYTPHVAVITNIESDHLDFYGSVE
AYVAVFDSFVERIVPGGAVVCTDDPGGAALAQRATELGIRVLRYGSVPGETMAATLVSWQQQGVG
AVAHIRLASELATAQGPRVMRLSVPGRHMALNALGALLAAVQIGAPADEVLDGLAGFEGVRRRFELV
GTCGVGKASVRVFDDYAHHPTEISATLAAARMVLEQGDGGRCMVVFQPHLYSRTKAFAAEFGRALN TABLE 4-continued

```
AADEVFVLDVYGAREQPLAGVSGASVAEHVTVPMRYVPDFSAVAQQVAAAASPGDVIVTMGAGDVT
LLGPEILTALRVRANRSAPGRPGVLG

>Rv2153c murG TB.seq 2412120:2413349 MW:41829 SEQ ID NO:223
VKDTVSQPAGGRGATAPRPADAASPSCGSSPSADSVSVVLAGGGTAGHVEPAMAVADALVALDPR
VRITALGTLRGLETRLVPQRGYHLELITAVPMPRKPGGDLARLPSRVWRAVREARDVLDDVDADVVV
GFGGYVALPAYLAARGLPLPPRRRRRIPVVIHEANARAGLANRVGAHTADRVLSAVPDSGLRRAEVV
GVPVRASIAALDRAVLRAEARAHFGFPDDARVLLVFGGSQGAVSLNRAVSGAAADLAAAGVCVLHA
HGPQNVLELRRRAQGDPPYVAVPYLDRMELAYAAADLVICRAGAMTVAEVSAVGLPAIYVPLPIGNG
EQRLNALPVVNAGGGMWADAALTPELVARQVAGLLTDPARLAAMTAAAARVGHRDAAGQVARAAL
AVATGAGARTTT

>Rv2154c ftsW TB.seq 2413349:2414920 MW:56306 SEQ ID NO:224
VLTRLLRRGTSDTDGSQTRGAEPVEGQRTGPEEASNPGSARPRTRFGAWLGRPMTSFHLIIAVAALL
TTLGLIMVLSASAVRSYDDDGSAWVIFGKQVLWTLVGLIGGYVCLRMSVRFMRRIAFSGFAITIVMLVL
VLVPGIGKEANGSRGWFVVAGFSMQPSELAKMAFAIWGAHLLAARRMERASLREMLIPLVIPAAVVAL
ALIVAQPDLGQTVSMGIILLGLLWYAGLPLRVFLSSLAAVVVSAAILAVSAGYRSDRVRSWLNPENDP
QDSGYQARQAKFALAQGGIFGDGLGQGVAKWNYLPNAHNDFIFAIIGEELGLVGALGLLGLFGLFAY
TGMRIASRSADPFLRLLTATTTLWVLGGAFINIGYVIGLLPVTGLQLPLISAGGTSTAATLSLIGIIANAAR
HEPEAVAALRAGRDDKVNRLLRLPLPEPYLPPRLEAFRDRKRANPQPAQTQPARKTPRTAPGQPAR
QMGLPPRPGSPRTADPPVRRSVHHGAGQRYAGQRRTRRVRALEGQRYG

>Rv2155c murD TB.seq 2414935:2416392 MW:49314 SEQ ID NO:225
VLDPLGPGAPVLVAGGRVTGQAVAAVLTRFGATPTVCDDDPVMLRPHAERGLPTVSSSDAVQQITG
YALVVASPGFSPATPLLAAAAAAGVPIWGDVELAWRLDAAGCYGPPRSWLVVTGTNGKTTTTSMLH
AMLIAGGRRAVLCGNIGSAVLDVLDEPAELLAVELSSFQLHWAPSLRPEAGAVLNIAEDHLDWHATM
AEYTAAAARVLTGGVAVAGLDDSRAAALLDGSPAQVRVGFRLGEPMRELGVRDAHLVDRAFSDDL
TLLPVASIPVPGPVGVLDALAAAALARSVGVPAGAIADAVTSFRVGRHRAVVAVADGITVVDDSKAT
NPHAARASVLAYPRVVWIAGGLLKGASLHAEVAAMASRLVGAVLIGRDRAAVAEALSRHAPDVPVVQ
VVAGEDTGMPATVEVPVACVLDVAKDDKAGETVGAAVMTAAVAAARRMAQPGDTVLLAPAGASFD
QFTGYADRGEAFATAVRAVIR

>Rv2156c murX TB.seq 2416397:2417473 MW:37714 SEQ ID NO:226
MRQILIAVAVAVTVSILLTPVLIRLFTKQGFGHQIREDGPPSHHTKRGTPSMGGVAILAGIWAGYLGAH
LAGLAFDGEGIGASGLLVLGLATALGGVGFIDDLIKIRRSRNLGLNKTAKTVGQITSAVLFGVLVLQFRN
AAGLTPGSADLSYVREIATVTLAPVLFVLFCVVIVSAWSNAVNFTDGLDGLAAGTMAMVTAAYVLITF
WQYRNACVTAPGLGCYNVRDPLDLALIAAATAGACIGFLWWNAAPAKIFMGDTGSLALGGVIAGLSV
TSRTEILAVVLGALFVAEITSVVLQILTFRTTGRRMFRMAPFHHHGELVGWAETTVIIRFWLLTAITCGL
GVALFYGEWLAAVGA

>Rv2157c murF TB.seq 2417473:2419002 MW:51634 SEQ ID NO:227
MIELTVAQIAEIVGGAVADISPQDAAHRRVTGTVEFDSRAIGPGGLFLALPGARADGHDHAASAVAAG
AAVVLAARPVGVPAIVVPPVAAPNVLAGVLEHDNDGSGAAVLAALAKLATAVAAQLVAGGLTIIGITGS
SGKTSTKDLMAAVLAPLGEVVAPPGSFNNELGHPWTVLRATRRTDYLILEMAARHHGNIAALAEIAPP
SIGVVLNVGTAHLGEFGSREVIAQTKAELPQAVPHSGAVVLNADDPAVAAMAKLTAARVVRVSRDNT
GDVWAGPVSLDELARPRFTLHAHDAQAEVRLGVCGDHQVTNALCAAAVALECGASVEQVAAALTAA
PPVSRHRMQVTTRGDGVTVIDDAYNANPDSMRAGLQALAWIAHQPEATRRSWAVLGEMAELGEDAI
AEHDRIGRLAVRLDVSRLVVVGTGRSISAMHHGAVLEGAWGSGEATADHGADRTAVNVADGDAALA
LLRAELRPGDVVLVKASNAAGLGAVADALVADDTCGSVRP

>Rv2158c murE TB.seq 2419002:2420606 MW:55310 SEQ ID NO:228
VSSLARGISRRRTEVATQVEAAPTGLRPNAVVGVRLAALADQVGAALAEGPAQRAVTEDRTVTGVTL
RAQDVSPGDLFAALTGSTTHGARHBGDAIARGAVAVLTDPAGVAEIAGRAAVPVLVHPAPRGVLGGL
AATVYGHPSERLTVIGITGTSGKTTTTYLVEAGLRAAGRVAGLIGTIGIRVGGADLPSALTTPEAPTLQA
MLAAMVERGVDTVVMEVSSHALALGRVDGTRFAVGAFTNLSRDHLDFHPSMADYFEAKASLFDPDS
ALRARTAVVCIDDDAGRAMAARAADAITVSAADRPAHWRATDVAPTDAGGQQFTAIDPAGVGHHIGI
RLPGRYNVANCLVALAILDTVGVSPEQAVPGLREIRVPGRLEQIDRGQGFLALVDYAHDPEALRSVLT
TLAHPDRRLAVVFGAGGDRDPGKRAPMGRIAAQLADLVVVTDDNPRDEDPTAIRREILAGAAEVGGD
AQVVEIADRRDAIRHAVAWARPGDVVLIAGKGHETGQRGGGRVRPFDDRVELAAALEALERRA

>Rv2159c - TB.seq 2420632:2421663 MW:36377 SEQ ID NO:229
MKFVNHIEPVAPRRAGGAVAEVYAEARREFGRLPEPLAMLSPDEGLLTAGWATLRETLLVGQVPRG
RKEAVAAAVAASLRCPWCVDAHTTMLYAAGQTDTAAAILAGTAPAAGDPNAPYVAWAAGTGTPAGP
PAPFGPDVAAEYLGTAVQFHFIARLVLVLLDETFLPGGPRAQQLMRRAGGLVFARKVRAEHRPGRST
RRLEPRTLPDDLAWATPSEPIATAFALLSHHLDTAPHLPPPTRQVVRRVVGSWHGEPMPMSSRWTN
EHTAELPADLHAPTRLALLTGLAPHQVTDDDVAAARSLLDTDAALVGALAWAAFTAARRIGTWIGAAA
EGQVSRQNPTG

>Rv2163c pbpB TB.seq 2425049:2427085 MW:72506 SEQ ID NO:230
VSRAAPRRASQSQSTRPARGLRRPPGAQEVGQRKRPGKTQKARQAQEATKSRPATRSDVAPAGR
STRARRTRQVVDVGTRGASFVFRHRTGNAVILVLMLVAATQLFFLQVSHAAGLRAQAAGQLKVTDV
QPAARGSIVDRNNDRLAFTIEARALTFQPKRIRRQLEEARKKTSAAPDPQQRLRDIAQEVAGKLNNKP
DAAAVLKKLQSDETFVYLARAVDPAVASAICAKYPEVGAERQDLRQYPGGSLAANVVGGIDWDGHG
LLGLEDSLDAVLAGTDGSVTYDRGSDGVVIPGSYRNRHKAVHGSTVVLTLDNDIQFYVQQQVQQAK
NLSGAHNVSAVVLDAKTGEVLAMANDNTFDPSQDIGRQGDKQLGNPAVSSPFEPGSVNKIVAASAVI
EHGLSSPDEVLQVPGSIQMGGVTVHDAWEHGVMPYTTTGVFGKSSNVGTLMLSQRVGPERYYDML
RKFGLGQRTGVGLPGESAGLVPPIDQWSGSTFANLPIGQGLSMTLLQMTGMYQAIANDGVRVPPRII
KATVAPDGSRTEEPRPDDIRVVSAQTAQTVRQMLRAVVQRDPMGYQQGTGPTAGVPGYQMAGKT
GTAQQINPGCGCYFDDVYWITFAGIATADNPRYVIGIMLDNPARNSDGAPGHSAAPLFHNIAGWLMQ
```

TABLE 4-continued

RENVPLSPDPGPPLVLQAT

>Rv2165c - TB.seq 2428236:2429423 MW:42498 SEQ ID NO:231
VQTRAPWSLPEATLAYFPNARFVSSDRDLGAGAAPGIAASRSTACQTWGGITVADPGSGPTGFGHV
PVLAQRCFELLTPALTRYYPDGSQAVLLDATIGAGGHAERFLEGLPGLRLIGLDRDPTALDVARSRLV
RFADRLTLVHTRYDCLGAALAESGYAAVGSVDGILFDLGVSSMQLDRAERGFAYATDAPLDMRMDP
TTPLTAADIVNTYDEAALADILRRYGEERFARRIAAGIVRRRAKTPFTSTAELVALLYQAIPAPARRVGG
HPAKRTFQALRIAVNDELESLRTAVPAALDALAIGGRIAVLAYQSLEDRIVKRVFAEAVASATPAGLPV
ELPGHEPRFRSLTHGAERASVAEIERNPRSTPVRLRALQRVEHRAQSQQWATEKGDS >Rv2166c - TB.seq 2429428:2429856 MW:15912 SEQ ID NO:232
MFLGTYTPKLDDKGRLTLPAKFRDALAGGLMVTKSQDHSLAVYPRAAFEQLARRASKAPRSNPEAR
AFLRNLAAGTDEQHPDSQGRITLSADHRRYASLSKDCWIGAVDYLEIWDAQAWQNYQQIHEENFSA
ASDEALGDIF >Rv2197c - TB.seq 2461505:2462146 MW:22481 SEQ ID NO:233
MVSRYSAYRRGPDVISPDVIDRILVGACAAVWLVFTGVSVAAAVALMDLGRGFHEMAGNPHTTWVL
YAVIVVSALVIVGAIPVLLRARRMAEAEPATRPTGASVRGGRSIGSGHPAKRAVAESAPVQHADAFEV
AAEWSSEAVDRIWLRGTVVLTSAIGIALIAVAAATYLMAVGHDGPSWISYGLAGVVTAGMPVIEWLYA
RQLRRVVAPQSS >Rv2198c - TB.seq 2462149:2463045 MW:30955 SEQ ID NO:234
MSGPNPPGREPDEPESEPVSDTGDERASGNHLPPVAGGGDKLPSDQTGETDAYSRAYSAPESEHV
TGGPYVPADLRLYDYDDYEESSDLDDELAAPRWPWVVGVAAIIMVALVVSVSLLVTRPHTSKLATG
DTTSSAPPVQDEITTTKPAPPPPPPAPPPUEIPTATETQTVTVTPPPPPPPATTTAPPPATTTTAAAP
PPTTTTPTGPRQVTYSVTGTKAPGDIISVTYVDAAGRRRTQHNVYIPWSMTVTPISQSDVGSVEASSL
FRVSKLNCSITTSDGTVLSSNSNDGPQTSC >Rv2199c - TB.seq 2463234:2463650 MW:14866 SEQ ID NO:235
MHIEARLFEFVAAFFVVTAVLYGVLTSMFATGGVEWAGTTALALTGGMALIVATFFRFVARRLDSRPE
DYEGAEISDGAGELGFFSPHSWWPIMVALSGSVAAVGIALWLPWLIAAGVAFILASAAGLVFEYYVGP
EKH >Rv2200c ctaC TB.seq 2463661:2464749 MW:40449 SEQ ID NO:236
VTPRGPGRLQRLSQCRPQRGSGGPARGLRQLALAAMLGALAVTVSGCSWSEALGIGWPEGITPEA
HLNRELWIGAVIASLAVGVIVWGLIFWSAVFHRKKNTDTELPRQFGYNMPLELVLTVIPFLIISVLFYFT
VVVQEKMLQIAKDPEVVIDITSFQWNWKFGYQRVNFKDGTLTYDGADPERKRAMVSKPEGKDKYGE
ELVGPVRGLNTEDRTYLNFDKVETLGTSTEIPVLVLPSGKRIEFQMASADVIHAFWVPEFLFKRDVMP
NPVANNSVNVFQIEEITKTGAFIVGHCAEMCGTYHSMMNFEVRVVTPNDFKAYLQQRIDGKTNAEALR
AINQPPLAVTTHPFDTRRGELAPQPVG >Rv2427c proA g-glutamyl phosphate reductase TB.seq 2724231:2725475 MW:43746
SEQ ID NO:237
MTVPAPSQLDLRQEVHDMRRARVAARRLASLPTTVKDRALHAAADELLAHRDQILAANAEDLNAAR
EADTPAAMLDRLSLNPQRVDGIAAGLRQVAGLRDPVGEVLRGYTLPNGLQLRQQRVPLGVVGMIYE
GRPNVTVDAFGLTLKSGNAALLRGSSSAAKSNEALVAVLRTALVGLELPADAVQLLSAADRATVTHLI
QARGLVDVVIPRGGAGLIEAVVWRDAQVPTIETGVGNCHVYVHQAADLDVAERILLNSKTRRPSVCNA
AETLLVDAAIAETALPRLLAALQHAGVTVHLDPDEADLRREYLSLDIAVAVVDGVDAAIAHINEYGTGH
TEAIVTTNLDAAQRFTEQIDAAAVMVNASTAFTDGEQFGFGAEIGISTQKLHARGPMGLPELTSTKWI
AWGAGHTRPA >Rv2438c - similar to YHN4_YEAST P38795 TB.seq 2734793:2737006 MW:80492
SEQ ID NO:238
MGLLGGQSGPRVGSGPVGSIPTPVNAAICQQRGGFHGVERGYSAGDSGVLTSLGDNERTMNFYSA
YQHGFVRVMCTHHTTIGDPAANAASVLDMARACHDDGAALAVFPELTLSGYSIEDVLLQDSLLDAV
EDALLDLVTESADLLPVLVVGAPLRHRHRIYNTAVVIHRGAVLGVVPKSYLPTYREFYERRQMAPGD
GERGTIRIGGADVAFGTDLLFAASDLPGFVLHVEICEDMFVPMPPSAEAALAGATVLANLSGSPITIGR
AEDRRLLARSASARCLAAYVYAAAGEGESTTDLAWDGQTMIWENGALLAESERFPKGVRRSVADVD
TELLRSERLRMGTFDDNRRHHRELTESFRRIDFALDPPAGDIGLLREVERFPFVPADPQRLQQDCYE
AYNIQVSGLEQRLRALDYPKVVIGVSGGLDSTHALIVATHAMDREGRPRSDILAFALPGFATGEHTKN
NAIKLARALGVTFSEIDIGDTARLMLHTIGHPYSVGEKVYDVTFENVQAGLRTDYLFRIANQRGGIVLG
TGDLSELALGWSTYGVGDQMSHYNVNAGVPKTLIQHLIRWVISAGEFGEKVGEVLQSVLDTEITPELI
PTGEEELQSSEAKVGPFALQDFSLFQVLRYGFRPSKIAFLAWHAWNDAERGNWPPGFPKSERPSYS
LAEIRHWLQIFVQRFYSFSQFKRSALPNGPKVSHGGALSPRGDWRAPSDMSARIWLDQIDREVPKG >Rv2439c proB glutamate 5-kinase TB.seq 2737118:2738245 MW:38789 SEQ ID NO:239
MRSPHRDAIRTARGLVVKVGTTALTTPSGMFDAGRLAGLAEAVERRMKAGSDVVIVSSGAIAAGIEPL
GLSRRPKDLATKQAAASVGQVALVNSWSAAFARYGRTVGQVLLTAHDISMRVQHTNAQRTLDRLRA
LHAVAIVNENDTVATNEIRFGDNDRLSALVAHLVGADALVLLSDIDGLYDCDPRKTADATFIPEVSGPA
DLDGVVAGRSSHLGTGGMASKVAAALLAADAGVPVLLAPAADAATALADASVGTVFAARPARLSAR
RFWVRYAAEATGALTLDAGAVRAVVRQRRSLLAAGITAVSGRFCGGDVVELRAPDAAMVARGVVAY
DASELATMVGRSTSELPGELRRPVVHADDLVAVSAKQAKQV >Rv2440c obg Obg GTP-binding protein TB.seq 2738248:2739684 MW:50430
SEQ ID NO:240
VPRFVDRVVIHTRAGSGGNGCASVHREKFKPLGGPDGGNGGRGGSIVFVVDPQVHTLLDFHFRPHL
TAASGKHGMGNNRDGAAGADLEVKVPEGTVVLDENGRLLADLVGAGTRFEAAAGGRGGLGNAALA
SRVRKAPGFALLGEKGQSRDLTLELKTVADVGLVGFPSAGKSSLVSAISAAKPKIADYPFTTLVPNLG
VVSAGEHAFTVADVPGLIPGASRGRGLGLDFLRHIERCAVLVHVVDCATAEPGRDPISDIDALETELA TABLE 4-continued CYTPTLQGDAALGDLAARPRAVVLNKIDVPEARELAEFVRDDIAQRGWPVFCVSTATRENLQPLIFGL
SQMISDYNAARPVAVPRRPVIRPIPVDDSGFTVEPDGHGGFVVSGARPERWIDQTNFDNDEAVGYL
ADRLARLGVEEELLRLGARSGCAVTIGEMTFDWEPQTPAGEPVAMSGRGTDPRLDSNKRVGAAER
KAARSRRREHGDG >Rv2441c rpmA 50S ribosomal protein L27 TB.seq 2739773:2740030 MW:8969
SEQ ID NO:241
MAHKKGASSSRNGRDSAAQRLGVKRYGGQAAKAGEILVRQRGTKFHPGVNVGRGGDDTLFAKTAG
AVEFGIKRGRKTVSIVGSTTA >Rv2442c rplU 50S ribosomal protein L21 TB.seq 2740048:2740359 MW:11152
SEQ ID NO:242
MMATYAIVKTGGKQYKVAVGDVVKVEKLESEQGEKVSLPVALVVDGATVTTDAKALAKVAVTGEVLG
HTKGPKIRIHKFKNKTGYHKRQGHRQQLTVLKVTGIA >Rv2448c valS valyl-tRNA synthase TB.seq 2747596:2750223 MW:97822 SEQ ID NO:243
MLPKSWDPAAMESAIYQKWLDAGYFTADPTSTKPAYSIVLPPPNVTGSLHMGHALEHTMMDALTRR
KRMQGYEVLWQPGTDHAGIATQSVVEQQLAVDGKTKEDLGRELFVDKVWDWKRESGGAIGGQMR
RLGDGVDWSRDRFTMDEGLSRAVRTIFKRLYDAGLIYRAERLVNWSPVLQTAISDLEVNYRDVEGEL
VSFRYGSLDDSQPHIVVATTRVETMLGDTAIAVHPDDERYRHLVGTSLAHPFVDRELAIVADEHVDPE
FGTGAVKVTPAHDPNDFEIGVRHQLPMPSILDTKGRIVDTGTRFDGMDRFEARVAVRQALAAQGRV
VEEKRPYLHSVGHSERSGEPIEPRLSLQWWVRVESLAKAAGDAVRNGDTVIHPASMEPRWFSWVD
DMHDWCISRQLWWGHRIPIWYGPDGEQVCVGPDETPPQGWEQDPDVLDTWFSSALWPFSTLGW
PDKTAELEKFYPTSVLVTGYDILFFWVARMMMFGTFVGDDAAITLDGRRGPCVPFTDVFLHGLIRDE
SGRKMSKSKGNVIDPLDWVEMFGADALRFTLARGASPGGDLAVSEDAVRASRNFGTKLFNATRYAL
LNGAAPAPLPSPNELTDADRWILGRLEEVRAEVDSAFDGYEFSRACESLYHFAWDEFCDWYLELAK
TQLAQGLTHTTAVLAAGLDTLLRLLHPVIPFLTEALWLALTGRESLVSADWPEPSGISVDLVAAQRIND
MQKLVTEVRRFRSDQGLADRQKVPARMHGVRDSDLSNQVAAVTSLAWLTEPGPDFEPSVSLEVRL
GPEMNRTVVVELDTSGTIDVAAERRRLEKELAGAQKELASTAAKLANADFLAKAPDAVIAKIRDRQRV
AQQETERITTRLAALQ >Rv2482c plsB2 TB.seq 2786915:2789281 MW:88284 SEQ ID NO:244
VTKPAADASAVLTAEDTLVLASTATPVEMELIMGWLGQQRARHPDSKFDILKLPPRNAPPAALTALVE
QLEPGFASSPQSGEDRSIVPVRVIWLPPADRSRAGKVAALLPGRDPYHPSQRQQRRILRTDPRRAR
VVAGESAKVSELRQQWRDTTVAEHKRDFAQFVSRRALLALARAEYRILGPQYKSPRLVKPEMLASA
RFRAGLDRIPGATVEDAGKMLDELSTGWSQVSVDLVSVLGRLASRGFDPEFDYDEYQVAAMRAALE
AHPAVLLFSHRSYIDGVVVPVAMQDNRLPPVHMFGGINLSFGLMGPLMRRSGMIFIRRNIGNDPLYK
YVLKEYVGYVVEKRFNLSWSIEGTRSRTGKMLPPKLGLMSYVADAYLDGRSDDILLQGVSICFDQLH
EITEYAAYARGAEKTPEGLRWLYNFIKAQGERNFGKIYVRFPEAVSMRQYLGAPHGELTQDPAAKRL
ALQKMSFEVAWRILQATPVTATGLVSALLLTTRGTALTLDQLHHTLQDSLDYLERKQSPVSTSALRLR
SREGVRAAADALSNGHPVTRVDSGREPVWYIAPDDEHAAAFYRNSVIHAFLETSIVELALAHAKHAE
GDRVAAFWAQAMRLRDLLKFDFYFADSTAFRANIAQEMAWHQDWEDHLGVGGNEIDAMLYAKRPL
MSDAMLRVFFEAYEIVADVLRDAPPDIGPEELTELALGLGRQFVAQGRVRSSEPVSTLLFATARQVAV
DQELIAPAADLAERRVAFRRELRNILRDFDYVEQIARNQFVACEFKARQGRDRI >Rv2509 - putative oxidoreductase TB.seq 2824676:2825479 MW:28014 SEQ ID NO:245
MPIPAPSPDARAVVTGASQNIGAALATELAARGHHLIVTARREDVLTELAARLADKYRVTVDVRPADL
ADPQERSKLADELAARPISILCANAGTATFGPIASLDLAGEKTQVQLNAVAVHDLTLAVLPGMIERKAG
GILISGSAAGNSPIPYNATYAATKAFVNTFSESLRGELRGSGVHVTVLAPGPVRTELPDASEASLVEKL
VPDFLWISTEHTARVSLNALERNKMRVVPGLTSKAMSVASQYAPRAIVAPIVGAFYKRLGGS >Rv2524c fas fatty acid synthase TB.seq 2840124:2849330 MW:326226 SEQ ID NO:246
VTIHEHDRVSADRGGDSPHTTHALVDRLMAGEPYAVAFGGQGSAWLETLEELVSATGIETELATLVG
EAELLLDPVTDELIVVRPIGFEPLQWVRALAAEDPVPSDKHLTSAAVSVPGVLLTQIAATRALARQGM
DLVATPPVAMAGHSQGVLAVEALKAGGARDVELFALAQLIGAAGTLVARRRGISVLGDRPPMVSVTN
ADPERIGRLLDEFAQDVRTVLPPVLSIRNGRRAVVITGTPEQLSRFELYCRQISEKEEADRKNKVRGG
DVFSPVFEPVQVEVGFHTPRLSDGIDIVAGWAEKAGLDVALARELADAILIRKVDWVDEITRVHAAGA
RWILDLGPGDILTRLTAPVIRGLGIGIVPAATRGGQRNLFTVGATPEVARAWSSYAPTVVRLPDGRVK
LSTKFTRLTGRSPILLAGMTPTTVDAKIVAAAANAGHWAELAGGGQVTEEIFGNRIEQMAGLLEPGRT
YQFNALFLDPYLWKLQVGGKRLVQKARQSGAAIDGVVISAGIPDLDEAVELIDELGDIGISHVVFKPGT
IEQIRSVIRIATEVPTKPVIMHVEGGRAGGHHSWEDLDDLLLATYSELRSRANITVCVGGGIGTPRRAA
EYLSGRWAQAYGFPLMPIDGILVGTAAMATKESTTSPSVKRMLVDTQGTDQWISAGKAQGGMASSR
SQLGADIHEIDNSASRCGRLLDEVAGDAEAVAERRDEIIAAMAKTAKPYFGDVADMTYLQWLRRYVE
LAIGEGNSTADTASVGSPWLADTWRDRFEQMLQRAEARLHPQDFGPIQTLFTDAGLLDNPQQAIAAL
LARYPDAETVQLHPADVPFFVTLCKTLGKPVNFVPVIDQDVRRWWRSDSLWQAHDARYDADAVCIIP
GTASVAGITRMDEPVGELLDRFEQAAIDEVLGAGVEPKDVASRRLGRADVAGPLAVVLDAPDVRWA
GRTVTNPVHRIADPAEWQVHDGPENPRATHSSTGARLQTHGDDVALSVPVSGTWVDIRFTLPANTV
DGGTPVIATEDATSAMRTVLAIAAGVDSPEFLPAVANGTATLTVDWHPERVADHTGVTATFGEPLAP
SLTNVPDALVGPCWPAVFAAIGSAVTDTGEPVVEGLLSLVHLDHAARVVGQLPTVPAQLTVTATAAN
ATDTDMGRWPVSVVVTGADGAVIATLEERFAILGRTGSAELADPARAGGAVSANATDTPRRRRRDV
TITAPVDMRPFAVVSGDHNPIHTDRAAALLAGLESPIVHGMWLSAAAQHAVTATDGQARPPARLVG
WTARFLGMVRPGDEVDFRVERVGIDQGAEIVDVAARVGSDLVMSASARLAAPKTVYAFPGQGIQHK
GMGMEVRARSKMRKVWDTADKFTRDTLGFSVLHWRDNPTSIIASGVHYHHPDGVLYLTQFTQVA
MATVAAAQVAEMREQGAFVEGAIACGHSVGEYTALACVTGIYQLEALLEMVFHRGSKMHDIVPRDEL
GRSNYRLAAIRPSQIDLDDADVPAFVAGIAESTGEFLEIVNFNLRGSQYAIAGTVRGLEALEAEVERRR
ELTGGRRSFILVPGIDVPFHSRVLRVGVAEFRRSLDRVMPRDADPDLIIGRYIPNLVPRLFTLDRDFIQ
EIRDLVPAEPLDEILADYDTWLRERPREMARTVFIELLAWQFASPVRWIETQDLLFIEEAAGGLGVERF
VEIGVKSSPTVAGLATNTLKLPEYAHSTVEVLNAERDAAVLFATDTDPEPEPEEDEPVAESPAPDVVS
EAAPVAPAASSAGPRPDDLVFDAADATLALIALSAKMRIDQIEELDSIESITDGASSRRNQLLVDLGSE TABLE 4-continued LNLGAIDGAAESDLAGLRSQVTKLARTYKPYGPVLSDAINDQLRTVLGPSGKRPGAIAERVKKTWELG
EGWAKHVTVEVALGTREGSSVRGGAMGHLHEGALADAASVDKVIDAAVASVAARQGVSVALPSAG
SGGGATIDAAALSEFTDQITGREGVLASAARLVLGQLGLDDPVNALPAAPDSELIDLVTAELGADWPR
LVAPVFDPKKAWFDDRWASAREDLVKLWLTDEGDIDADWPRLAERFEGAGHVVATQATWWQGKS
LAAGRQIHASLYGRIAAGAENPEPGRYGGEVAVVTGASKGSIAASVVARLLDGGATVIATTSKLDEER
LAFYRTLYRDHARYGAALWLVAANMASYSDVDALVEWIGTEQTESLGPQSIHIKDAQTPTLLFPFAAP
RVVGDLSEAGSRAEMEMKVLLWAVQRLIGGLSTIGAERDIASRLHVVLPGSPNRGMFGGDGAYGEA
KSALDAVVSRWHAESSWAARVSLAHALIGWTRGTGLMGHNDAIVAAVEEAGVTTYSTDEMAALLLD
LCDAESKVAAARSPIKADLTGGLAEANLDMAELAAKAREQMSAAAAVDEDAEAPGAIAALPSPPRGF
TPAPPPQWDDLDVDPADLVVIVGGAEIGPYGSSRTRFEMEVENELSAAGVLELAWTTGLIRWEDDP
QPGWYDTESGEMVDESELVQRYHDAWQRVGIREFVDDGAIDPDHASPLLVSVFLEKDFAFVVSSE
ADARAFVEFDPEHTVIRPVPDSTDWQVIRKAGTEIRVPRKTKLSRVVGGQIPTGFDPTVWGISADMA
GSIDRLAVWNMVATVDAFLSSGFSPAEVMRYVHPSLVANTQGTGMGGGTSMQTMYHGNLLGRNKP
NDIFQEVLPNIIMHVVQSYVGSYGAMIHPVAACATAAVSVEEGVDKIRLGKAQLVVAGGLDDLTLEGII
GFGDMAATADTSMMCGRGIHDSKFSRPNDRRRLGFVEAQGGGTILLARGDLALRMGLPVLAVVAFA
QSFGDGVHTSIPAPGLGALGAGRGGKDSPLARALAKLGVAADDVAVISKHDTSTLANDPNETELHER
LADALGRSEGAPLFVVSQKSLTGHAKGGAAVFQMMGLCQILRDGVIPPNRSLDCVDDELAGSAHFV
WVRDTLRLGGKFPLKAGMLTSLGFGHVSGLVALVHPQAFIASLDPAQRADYQRRADARLLAGQRRL
ASAIAGGAPMYQRPGDRRFDHHAPERPQEASMLLNPAARLGDGEAYIG >Rv2555c alaS alanyl-tRNA synthase TB.seq 2873772:2876483 MW:97326 SEQ ID NO:247
VQTHEIRKRFLDHFVKAGHTEVPSASVILDDPNLLFVNAGMVQFVPFFLGQRTPPYPTATSIQKCIRTP
DIDEVGITTRHNTFFQMAGNFSFGDYFKRGAIELAWALLTNSLAAGGYGLDPERIVYTTWFDDDEAV
RLWQEVAGLPAERIQRRGMADNYWSMGIPGPCGPSSEIYYDRGPEFGPAGGPIVSEDRYLEVWNL
VFMQNERGEGTTKEDYQILGPLPRKNIDTGMGVERIALVLQDVHNVYETDLLRPVIDTVARVAARAYD
VGNHEDDVRYRIIADHSRTAAILIGDGVSPGNDGRGYVLRRLLRRVIRSAKLLGIDAAIVGDLMATVRN
AMGPSYPELVADFERISRIAVAEETAFNRTLASGSRLFEEVASSTKKSGATVLSGSDAFTLHDTYGFPI
ELTLEMAAETGLQVDEIGFRELMAEQRRRAKADAAARKHAHADLSAYRELVDAGATEFTGFDELRS
QARILGIFVDGKRVPVVAHGVAGGAGEGQRVELVLDRTPLYAESGGQIADEGTISGTGSSEAARAAV
TDVQKIAKTLWVHRVNVESGEFVEGDTVIAAVDPGWRRGATQGHSGTHMVHAALRQVLGPNAVQA
GSLNRPGYLRFDFNWQGPLTDDQRTQVEEVTNEAVQADFEVRTFTEQLDKAKAMGAIALFGESYPD
EVRVVEMGGPFSLELCGGTHVSNTAQIGPVTILGESSIGSGVRRVEAYVGLDSFRHLAKERALMAGL
ASSLKVPSEEVPARVANLVERLRAAEKELERVRMASARAAATNAAAGAQRIGNVRLVAQRMSGGMT
AADLRSLIGDIRGKLGSEPAVVALIAEGESQTVPYAVAANPAAQDLGIRANDLVKQLAVAVEGRGGGK
ADLAQGSGKNPTGIDAALDAVRSEIAVIARVG >Rv2580c hisS histidyl-tRNA synthase TB.seq 2904822:2906090 MW:45118 SEQ ID NO:248
VTEFSSFSAPKGVPDYVPPDSAQFVAVRDGLLAAARQAGYSHIELPIFEDTALFARGVGESTDVVSKE
MYTFADRGDRSVTLRPEGTAGVVRAVIEHGLDRGALPVKLCYAGPFFRYERPQAGRYRQLQQVGV
EAIGVDDPALDAEVIAIADAGFRSLGLDGFRLEITSLGDESCRPQYRELLQEFLFGLDLDEDTRRRAGI
NPLRVLDDKRPELRAMTASAPVLLDHLSDVAKQHFDTVLAHLDALGVPYVINPRMVRGLDYYTKTAF
EFVHDGLGAQSGIGGGGRYDGLMHQLGGQDLSGIGFGLGVDRTVLALRAEGKTAGDSARCDVFGV
PLGEAAKLRLAVLAGRLRAAGVRVDLAYGDRGLKGAMRAAARSGARVALVAGDRDIEAGTVAVKDL
TTGEQVSVSMDSVVAEVISRLAG >Rv2614c thrS threonyl-tRNA synthase TB.seq 2941190:2943265 MW:77123 SEQ ID NO:249
MSAPAQPAPGVDGGDPSQARIRVPAGTTAATAVGEAGLPRRGTPDAIVVVRDADGNLRDLSWVPD
VDTDITPVAANTDDGRSVIRHSTAHVLAQAVQELFPQAKLGIGPPITDGFYYDFDVPEPFTPEDLAALE
KRMRQIVKEGQLFDRRVYESTEQARAELANEPYKLELVDDKSGDAEIMEVGGDELTAYDNLNPRTR
ERVWGDLCRGPHIPTTKHIPAFKLTRSSAAYWRGDQKNASLQRIYGTAWESQEALDRHLEFIEEAQR
RDHRKLGVELDLFSFPDEIGSGLAVFHPKGGIVRRELEDYSRRKHTEAGYQFVNSPHITKAQLFHTSG
HLDWYADGMFPPMHIDAEYNADGSLRKPGQDYYLKPMNCPMHCLIFRARGRSYRELPLRLFEFGTV
YRYEKSGVVHGLTRVRGLTMDDAHIFCTRDQMRDELRSLLRFVLDLLADYGLTDFYLELSTKDPEKF
VGAEEVWEEATTVLAEVGAESGLELVPDPGGAAFYGPKISVQVKDALGRTWQMSTIQLDFNFPERF
GLEYTAADGTRHRPVMIHRALFGSIERFFGILTEHYAGAFPAWLAPVQVVGIPVADEHVAYLEEVATQ
LKSHGVRAEVDASDDRMAKKIVHHTNHKVPFMVLAGDRDVAAGAVSFRFGDRTQINGVARDDAVAA
IVAWIADRENAVPTAELVKVAGRE >Rv2697c dut deoxyuridine triphosphatase TB.seq 3013683:3014144 MW:15772 SEQ ID NO:250
VSTTLAIVRLDPGLPLPSRAHDGDAGVDLYSAEDVELAPGRRALVRTGVAVAVPFGMVGLVHPRSGL
ATRVGLSIVNSPGTIDAGYRGEIKVALINLDPAAPIVVHRGDRIAQLLVQRVELVELVEVSSFDEAGLAS
TSRGDGGHGSSGGHASL >Rv2782c pepR protease/peptidase, M16 family (insulinase) TB.seq 3089045:3090358 MW:47074 SEQ ID NO:251
MPRRSPADPAAALAPRRTTLPGGLRVVTEFLPAVHSASVGVWVGVGSRDEGATVAGAAHFLEHLLF
KSTPTRSAVDIAQAMDAVGGELNAFTAKEHTCYYAHVLGSDLPLAVDLVADVVLNGRCAADDVEVER
DVVLEEIAMRDDDPEDALADMFLAALFGDHPVGRPVIGSAQSVSVMTRAQLQSFHLRRYTPERMVV
AAAGNVDHDGLVALVREHFGSRLVRGRRPVAPRKGTGRVNGSPRLTLVSRDAEQTHVSLGIRTPGR
GWEHRWALSVLHTALGGGLSSRLFQEVRETRGLAYSVYSALDLFADSGALSVYAACLPERFADVMR
VTADVLESVARDGITEAECGIAKGSLRGGLVLGLEDSSSRMSRLGRSELNYGKHRSIEHTLRQIEQVT
VEEVNAVARHLLSRRYGAAVLGPHGSKRSLPQQLRAMVG >Rv2783c gpsI pppGpp synthase and polyribonucleotide phosphorylase TB.seq 3090339:3092594 MW:79736 SEQ ID NO:252
MSAAEIDEGVFETTATIDNGSFGTRTIRFETGRLALQAAGAVVAYLDDDNMLLSATTASKNPKEHFDF
FPLTVDVEERMYAAGRIPGSFFRREGRPSTDAILTCRLIDRPLRPSFVDGLRNEIQIVVTILSLDPGDLY
DVLAINAASASTQLGGLPFSGPIGGVRVALIDGTWVGFPTVDQIERAVFDMWAGRIVEGDVAIMMVE
AEATENVVELVEGGAQAPTESVVMGLEAAKPFIAALCTAQQELADAAGKSGKPTVDFPVFPDYGED TABLE 4-continued VVYYSVSSVATDELAAALTIGGKAERDQRIDEIKTQVVQRLADTYEGREKEVGAALRALTKKLVRQRILT
DHFRIDGRGITDIRALSAEVAVVPRAHGSALFERGETQILGVTTLDMIKMAQQIDSLGPETSKRYMHH
YNFPPFSTGETGRVGSPKRREIGHGALAERALVPVLPSVEEFPYAIRQVSEALGSNGSTSMGSVCAS
TLALLNAGVPLKAPVAGIAMGLVSDDIQVEGAVDGVVERRFVTLTDILGAEDAFGDMDFKVAGTKDFV
TALQLDTKLDGIPSQVLAGALEQAKDARLTILEVMAEAIDRPDEMSPYAPRVTTIKVPVDKIGEVIGPK
GKVINAITEETGAQISIEDDGTVFVGATDGPSAQAAIDKINAIANPQLPTVGERFLGTVVKTTDFGAFVS
LLPGRDGLVHISKLGKGKRIAKVEDVVNVGDKLRVEIADIDKRGKISLILVADEDSTAAATDAATVTS >Rv2793c truB tRNA pseudouridine 55 synthase TB.seq 3102364:3103257 MW:31821
SEQ ID NO:253
MSATGPGIVVIDKPAGMTSHDVVGRCRRIFATRRVGHAGTLDPMATGVLVIGIERATKILGLLTAAPKS
YAATIRLGQTTSTEDAEGQVLQSVPAKHLTIEAIDAAMERLRGEIRQVPSSVSAIKVGGRRAYRLARQ
GRSVQLEARPIRIDRFELLAARRRDQLIDIDVEIDCSSGTYIRALARDLGDALGVGGHVTALRRTRVGR
FELDQARSLDDLAERPALSLSLDEACLLMFARRDLTAAEASAAANGRSLPAVGIDGVYAACDADGRVI
ALLRDEGSRTRSVAVLRPATMHPG >Rv2797c - TB.seq 3105619:3107304 MW:58761 SEQ ID NO:254
VPLTVADIDRWNAQAVREVFHAASARAEVTFEASRQLAALSIFANSGGKTAEAAAHHNAGIRRDLDA
HGNEALAVARAADRAADGIVKVQSELAALRHAAAAAELTIDALINRVVPIPGLRSTEAQWARTLAKQT
ELQAELDAIMAEANAVDEELASAVNMADGDAPIPADSGPPVGPEGLTPTQLASDANEERLREERARL
QAHLERLQAEYDQLSVRAARDYHNGILDGDAVGRLAALTDELSAARGRLGELDAVDEALSRAPETYL
TQLQIPEDPNQQVLAAVAVGNPDTAANVSVTVPGVGSTTRGALPGMVTEARDLRSEVIRQLNAAGK
PASVATIAWMGYHPPPNPLDTGSAGDLWQTMTDGQAHAGAADLSRYLQQVRANNPSGHLTVLGHS
YGSLTASLALQDLDAQSAHPVNDVVFYGSPGLELYSPAQLGLDHGHAYVMQAPHDLITNLVAPLAPL
HGWGLDPYLTPGFTELSSQAGFDPGGIWRDGVYAHGDYPRSFLDAAGQPQLRMSGYNLAAIAAGL
PDNTVGPPLLPPILGGGMPAAPGPALRGGR >Rv2864c ponA2 TB.seq 3175454:3177262 MW:63015 SEQ ID NO:255
MVTKTTLASATSGLLLLAVVAMSGQTPRPQGPGPAAEKFFAALAIGDTASAAQLSDNPNEAREALNA
AWAGLQAAHLDAQVLSAKYAEDTGTVAYRFSWHLPKDRIWTYDGQLKMARDEGRWHVRWTTSGL
HPKLGEHQTFALRADPPRRASVNEVGGTDVLVPGYLYHYSLDAGQAGRELFGTAHAVVGALHPFDD
TLNDPQLLAEQASSSTQPLDLVTLHADDSNRVAAAIGQLPGVVITPQAELLPTDKHFAPAVLNDVKKA
VVDELDGKAGWRVVSVNQNGVDVSVLHEVAPSPASSVSITLDRVVQNAAQHAVNTRGGKAMIVVIK
PSTGEILAIAQNAGADADGPVATTGLYPPGSTFKMITAGAAVERDLATPETLLGCPGEIDIGHRTIPNY
GGFDLGVVPMSRAFASSCNTTFAELSSRLPPRGLTQAARRYGIGLDYQVDGITTVTGSVPPTVDLAE
RTEDGFGQGKVLASPFGMALVAATVAAGKTPVPQLIAGRPTAVEGDATPISQKMIDALRPMMRLVVT
NGTAKEIAGCGEVFGKTGEAEFPGGSHSWFAGYRGDLAFASLIVGGGSSEYAVRMTKVMFESLPPG
YLA >Rv2868c gcpE TB.seq 3179368:3180528 MW:40451 SEQ ID NO:256
VTVGLGMPQPPAPTLAPRRATRQLMVGNVGVGSDHPVSVQSMCTTKTHDVNSTLQQIAELTAAGC
DIVRVACPRQEDADALAEIARHSQIPVVADIHFQPRYIFAAIDAGCAAVRVNPGNIKEFDGRVGEVAKA
AGAAGIPIRIGVNAGSLDKRFMEKYGKATPEALVESALWEASLFEEHGFGDIKISVKHNDPVVMVAAY
ELLAARCDYPLHLGVTEAGPAFQGTIKSAVAFGALLSRGIGDTIRVSLSAPPVEEVKVGNQVLESLNL
RPRSLEIVSCPSCGRAQVDVYTLANEVTAGLDGLDVPLRVAVMGCVVNGPGEAREADLGVASGNGK
GQIFVRGEVIKTVPEAQIVETLIEEAMRLAAEMGEQDPGATPSGSPIVTVS >Rv2869c - TB.seq 3180548:3181759 MW:42835 SEQ ID NO:257
MMFVTGIVLFALAILISVALHECGHMWVARRTGMKVRRYFVGFGPTLWSTRRGETEYGVKAVPLGG
FCDIAGMTPVEELDPDERDRAMYKQATWKRVAVLFAGPGMNLAICLVLIYAIALVWGLPNLHPPTRAV
IGETGCVAQEVSQGKLEQCTGPGPAALAGIRSGDVVVKVGDTPVSSFDEMAAAVRKSHGSVPIVVE
RDGTAIVTYVDIESTQRWIPNGQGGELQPATVGAIGVGAARVGPVRYGVFSAMPATFAVTGDLTVEV
GKALAALPTKVGALVRAIGGGQRDPQTPISVVGASIIGGDTVDHGLWVAFWFFLAQLNLILAAINLLPL
LPFDGGHIAVAVFERIRNMVRSARGKVAAAPVNYLKLLPATYVVLVLVVGYMLLTVTADLVNPIRLFQ >Rv2870c - TB.seq 3181770:3183077 MW:45324 SEQ ID NO:258
VATGGRVVIRRRGDNEVVAHNDEVTNSTDGRADGRLRVVVLGSTGSIGTQALQVIADNPDRFEVVG
LAAGGAHLDTLLRQRAQTGVTNIAVADEHAAQRVGDIPYHGSDAATRLVEQTEADVVLNALVGALGL
RPTLAALKTGARLALANDESLVAGGSLVLRAARPGQIVPVDSEHSALAQCLRGGTPDEVAKLVLTAS
GGPFRGWSAADLEHVTPEQAGAHPTWSMGPMNTLNSASLVNKGLEVIETHLLFGIPYDRIDVVVHP
QSIIHSMVTFIDGSTIAQASPPDMKLPISLALGWPRRVSGAAAACDFHTASSWEFEPLDTDVFPAVEL
ARQAGVAGGCMTAVYNAANEEAAAFLAGRIGFPAIVGIIADVLHAADQWAVEPATVDDVLDAQRWA
RERAQRAVSGMASVAIASTAKPGAAGRHASTLERS >Rv2922c smc member of Smc1/Cut3/Cut14 family TB.seq 3234189:3238055 MW:139610
SEQ ID NO:259
VGAGSRFPLVDPLPSVGARPDRLRGQPRRRTRAGGRPGSARCVPEAAAAAAGRHDTGPRRQSRR
RLVAVDGADHRVQRAVIWPLVYLKSLTLKGFKSFAAPTTLRFEPGITAVVGPNGSGKSNVVDALAWV
MGEQGAKTLRGGKMEDVIFAGTSSRAPLGRAEVTVSIDNSDNALPIEYTEVSITRRMFRDGASEYEIN
GSSCRLMDVQELLSDSGIGREMHVIVGQGKLEEILQSRPEDRRAFIEEAAGVLKHRKRKEKALRKLDT
MAANLARLTDLTTELRRQLKPLGRQAEAAQRAAAIQADLRDARLRLAADDLVSRRAEREAVFQAEAA
MRREHDEAAARLAVASEELAAHESAVAELSTRAESIQHTWFGLSALAERVDATVRIASERAHHLDIEP
VAVSDTDPRKPEELEAEAQQVAVAEQQLLAELDAARARLDAARAELADRERRAAEADRAHLAAVRE
EADRREGLARLAGQVETMRARVESIDESVARLSERIEDAAMRAQQTRAEFETVQGRIGELDQGEVG
LDEHHERTVAALRLADERVAELQSAERAAERQVASLRARIDALAVGLQRKDGAAWLAHNRSGAGLF
GSIAQLVKVRSGYEAALAAALGPAADALAVDGLTAAGSAVSALKQADGGRAVLVLSDQPAPQAPQS
ASGEMLPSGAQWALDLVESPPQLVGAMIAMLSGVAVVNDLTEAMGLVEIRPELRAVTVDGDLVGAG
WVSGGSDRKLSTLEVTSEIDKARSELAAAEALAAQLNAALAGALTEQSARQDAAEQALAALNESDTAI
SAMYEQLGRLGQEARAAEEEWNRLLQQRTEQEQVRTQTLDDVIQLETQLRKAQETQRVQVAQPIDR TABLE 4-continued QAISAAADRARGVEVEARLAVRTAEERANAVRGRADSLRRAAAAEREARVRAQQARAARLHAAAVA
AAVADCGRLLAGRLHRAVDGASQLRDASAAQRQQRLAAMAAVRDEVNTLSARVGELTDSLHRDEL
ANAQAALRIEQLEQMVLEQFGMAPADLITEYGPHVALPPTELEMAEFEQARERGEQVIAPAPMPFDR
VTQERRAKRAERALAELGRVNPLALEEFAALEERYNFLSTQLEDVKAARKDLLGVVADVDARILQVFN
DAFVDVEREFRGVFTALFPGGEGRLRLTEPDDMLTTGIEVEARPPGKKITRLSLLSGGEKALTAVAML
VAIFRARPSPFYIMDEVEAALDDVNLRRLLSLFEQLREQSQIIIITHQKPTMEVADALYGVTMQNDGITA
VISQRMRGQQVDQLVTNSS >Rv2925c rnc RNAse III TB.seq 3239829:3240548 MW:25400 SEQ ID NO:260
MIRSRQPLLDALGVDLPDELLSLALTHRSYAYENGGLPTNERLEFLGDAVLGLTITDALFHRHPDRSE
GDALAKLRASVVNTQALADVARRLCAEGLGVHVLLGRGEANTGGADKSSILADGMESLLGAIYLQHGM
EKAREVILRLFGPLLDAAPTLGAGLDWKTSLQELTAARGLGAPSYLVTSTGPDHDKEFTAVVVVMDS
EYGSGVGRSKKEAEQKAAAAAWKALEVLDNAMPGKTSA >Rv2934 ppsD TB.seq 3262245:3267725 MW:193317 SEQ ID NO:261
MTSLAERAAQLSPNARAALARELVRAGTTFPTDICEPVAVVGIGCRFPGNVTGPESFWQLLADGVDT
IEQVPPDRWDADAFYDPDPSASGRMTTKWGGFVSDVDAFDADFFGITPREAVAMDPQHRMLLEVA
WEALEHAGIPPDSLSGTRTGVMMGLSSWDYTIVNIERRADIDAYLSTGTPHCAAVGRIAYLLGLRGPA
VAVDTACSSSLVAIHLACQSLRLRETDVALAGGVQLTLSPFTAIALSKWSALSPTGRCNSFDANADGF
VRGEGCGVVVLKRLADAVRDQDRVLAVVRGSATNSDGRSNGMTAPNALAQRDVITSALKLADVTPD
SVNYVETHGTGTVLGDPIEFESLAATYGLGKGQGESPCALGSVKTNIGHLEAAAGVAGFIKAVLAVQR
GHIPRNLHFTRWNPAIDASATRLFVPTESAPWPAAAGPRRAAVSSFGLSGTNAHVVVEQAPDTAVAA
AGGMPYVSALNVSGKTAARVASAAAVLADWMSGPGAAAPLADVAHTLNRHRARHAKFATVIARDRA
EAIAGLRALAAGQPRVGVVDCDQHAGGPGRVFVYSGQGSQWASMGQQLLANEPAFAKAVAELDPI
FVDQVGFSLQQTLIDGDEVVGIDRIQPVLVGMQLALTELWRSYGVIPDAVIGHSMGEVSAAVVAGALT
PEQGLRVITTRSRLMARLSGQGAMALLELDADAAEALIAGYPQVTLAVHASPRQTVIAGPPEQVDTVI
AAVATQNRLARRVEVDVASHHPIIDPILPELRSALADLTPQPPSIPIISTTYESAQPVADADYWSANLRN
PVRFHQAVTAAGVDHNTFIEISPHPVLTHALTDTLDPDGSHTVMSTMNRELDQTLYFHAQLAAVGVA
ASEHTTGRLVDLPPTPWHHQRFWVTDRSAMSELAATHPLLGAHIEMPRNGDHVWQTDVGTEVCPW
LADHKVFGQPIMPAAGFAEIALAAASEALGTAADAVAPNIVINQFEVEQMLPLDGHTPLTTQLIRGGDS
QIRVEIYSRTRGGEFCRHATAKVEQSPRECAHAHPEAQGPATGTTVSPADFYALLRQTGQHHGPAF
AALSRIVRLADGSAETEISIPDEAPRHPGYRLHPVVLDAALQSVGAAIPDGEIAGSAEASYLPVSFETIR
VYRDIGRHVRCRAHLTNLDGGTGKMGRIVLINDAGHIAAEVDGIYLRRVERRAVPLPLEQKIFDAEWT
ESPIAAVPAPEPAAETTRGSWLVLADATVDAPGKAQAKSMADDFVQQWRSPMRRVHTADIHDESAV
LAAFAETAGDPEHPPVGVVVFVGGASSRLDDELAAARDTVWSITVVVRAVVGTWHGRSPRLWLVTG
GGLSVADDEPGTPAAASLKGLVRVLAFEHPDMRTTLVDLDITQDPLTALSAELRNAGSGSRHDDVIA
WRGERRFVERLSRATIDVSKGHPVVRQGASYVVTGGLGGLGLVVARWLVDRGAGRVVLGGRSDPT
DEQCNVLAELQTRAEIVVVRGDVASPGVAEKLIETARQSGGQLRGVVHAAAVIEDSLVFSMSRDNLE
RVWAPKATGALRMHEATADCELDWWLGFSSAASLLGSPGQAAYACASAWLDALVGWRRASGLPA
AVINWGPWSEVGVAQALVGSVLDTISVAEGIEALDSLLAADRIRTGVARLRADRALVAFPEIRSISYFT
QVVEELDSAGDLGDWGGPDALADLDPGEARRAVTERMCARIAAVMGYTDQSTVEPAVPLDKPLTEL
GLDSLMAVRIRNGARADFGVEPPVALILQGASLHDLTADLMRQLGLNDPDPALNNADTIRDRARQRA
AARHGAAMRRRPKPEVQGG >Rv2946c pks1 TB.seq 3291503:3296350 MW:166642 SEQ ID NO:262
VISARSAEALTAQAGRLMAHVQANPGLDPIDVGCSLASRSVFEHRAVVVGASREQLIAGLAGLAAGE
PGAGVAVGQPGSVGKTVVVFPGQGAQRIGMGRELYGELPVFAQAFDAVADELDRHLRLPLRDVIW
GADADLLDSTEFAQPALFAVEVASFAVLRDWGVLPDFVMGHSVGELAAAHAAGVLTLADAAMLVVA
RGRLMQALPAGGAMVAVAASEDEVEPLLGEGVGIAAINAPESVVISGAQAAANAIADRFAAQGRRVH
QLAVSHAFHSPLMEPMLEEFARVAARVQAREPQLGLVSNVTGELAGPDFGSAQYWVDHVRRPVRF
ADSARHLQTLGATHFIEASGPGSGLTGSIEQSLAPAEAMVVSMLGKDRPELASALGAAGQVFTTGVPV
QWSAVFAGSGGRRVQLPTYAFQRRRFWETPGADGPADAAGLGLGATEHALLGAVVERPDSDEVVL
TGRLSLADQPWLADHVVNGVVLFGAGFVELVIRAGDEVGCALIEELVLAAPLVMHPGVGVQVQVVV
GAADESGHRAVSVYSRGDQSQGWLLNAEGMLGVAAAETPMDLSVWPPEGAESVDISDGYAQLAE
RGYAYGPAFQGLVAIWRRGSELFAEVVAPGEAGVAVDRMGMHPAVLDAVLHALGLAVEKTQASTET
RLPFCWRGVSLHAGGAGRVRARFASAGADAISVDVCDATGLPVLTVRSLVTRPITAEQLRAAVTAAG
GASDQGPLEVVWSPISVVSGGANGSAPPAPVSWADFCAGSDGDASVVVWELESAGGQASSVVGS
VYAATHTALEVLQSWLGADRAATLVVLTHGGVGLAGEDISDLAAAAVWGMARSAQAENPGRIVLIDT
DAAVDASVLAGVGEPQLLVRGGTVHAPRLSPAPALLALPAAESAWRLAAGGGGTLEDLVIQPCPEV
QAPLQAGCVRVAVAAVGVNFRDVVAALGMYPGQAPPLGAEGAGVVLETGPEVTDLAVGDAVMGFL
GGAGPLAVVDQQLVTRVPQGWSFAQAAAVPVVFLTAWYGLADLAEIKAGESVLIHAGTGGVGMAAV
QLARQWGVEVFVTASRGKWDTLRAMGFDDDHIGDSRTCEFEEKFLAVTEGRGVDVVLDSLAGEFV
DASLRLLVRGGRFLEMGKTDIRDAQEIAANYPGVQYRAFDLSEAGPARMQEMLAEVRELFDTRELH
RLPVTTWDVRCAPAAFRFMSQARHIGKVVLTMPSALADRLADGTVVITGATGAVGGVLARHLVGAY
GVRHLVLASRRGDRAEGAAELAADLTEAGAKVQVVACDVADRAAVAGLFAQLSREYPPVRGVIHAA
GVLDDAVITSLTPDRIDTVLRAKVDAAWNLHQATSDLDLSMFALCSSIAATVGSPGQGNYSAANAFLD
GLAAHRQAAGLAGISLAWGLWEQPGGMTAHLSSRDLARMSRSGLAPMSPAEAVELFDAALAIDHPL
AVATLLDRAALDARAQAGALPALFSGLARRPRRRQIDDTGDATSSKSALAQRLHGLAADEQLELLVG
LVCLQAAAVLGRPSAEDVDPDTEFGDLGFDSLTAVELRNRLKTATGLTLPPTVIFDHPTPTAVAEYVA
QQMSGSRPTESGDPTSQVVEPAAAEVSVHA >Rv3014c ligA DNA ligase TB.seq 3372545:3374617 MW:75258 SEQ ID NO:263
VSSPDADQTAPEVLRQWQALAEEVREHQFRYYVRDAPIISDAEFDELLRRLEALEEQHPELRTPDSP
TQLVGGAGFATDFEPVDHLERMLSLDNAFTADELAAWAGRIHAEVGDAAHYLCELKIDGVALSLVYR
EGRLTRASTRGDGRTGEDVTLNARTIADVPERLTPGDDYPVPEVLEVRGEVFFRLDDFQALNASLVE
EGKAPFANPRNSAAGSLRQKDPAVTARRRLRMICHGLGHVEGFRPATLHQAYLALRAWGLPVSEHT
TLATDLAGVRERIDYWGEHRHEVDHEIDGVVVKVDEVALQRRLGSTSRAPRWAIAYKYPPEEAQTKL
LDIRVNVGRTGRITPFAFMTPVKVAGSTVGQATLHNASEIKRKGVLIGDTVVIRKAGDVIPEVLGPVVE
LRDGSEREFIMPTTCPECGSPLAPEKEGDADIRCPNARGCPGQLRERVFHVASRNGLDIEVLGYEAG TABLE 4-continued VALLQAKVIADEGELFALTERDLLRTDLFRTKAGELSANGKRLLVNLDKAKAAPLWRVLVALSIRHVGP
TAARALATEFGSLDAIAAASTDQLAAVEGVGPTIAAAVTEWFAVDWHREIVDKWRAAGVRMVDERD
ESVPRTLAGLTIVVTGSLTGFSRDDAKEAIVARGGKAAGSVSKKTNYVVAGDSPGSKYDKAVELGVPI
LDEDGFRRLLADGPASRT >Rv3025c - NifS-like protein TB.seq 3383885:3385063 MW:40948 SEQ ID NO:264
MAYLDHAATTPMHPAAIEAMAAVQRTIGNASSLHTSGRSARRRIEEARELIADKLGARPSEVIFTAGG
TESDNLAVKGIYWARRDAEPHRRRIVTTEVEHHAVLDSVNWLVEHEGAHVTWLPTAADGSVSATAL
REALQSHDDVALVSVMWANNEVGTILPIAEMSVVAMEFGVPMHSDAIQAVGQLPLDFGASGLSAMS
VAGHKFGGPPGVGALLLRRDVTCVPLMHGGGQERDIRSGTPDVASAVGAAAATMQIAVDGLEENSAR
LRLLRDRLVEGVLAEIDDVCLNGADDPMRLAGNAHFTFRGCEGDALLMLLDANGIECSTGSACTAGV
AQPSHVLIAMGVDAASARGSLRLSLGHTSVEADVDAALEVLPGAVARARRAALAAAGASR >Rv3080c pknK serine-threonine protein kinase TB.seq 3442656:3445985 MW:119420
SEQ ID NO:265
MTDVDPHATRRDLVPNIPAELLEAGFDNVEEIGRGGFGVVYRCVQSLDRAVAVKVLSTDLDRDNLE
RFLREQRAMGRLSGHPHIVTVLQVGVLAGGRPFIVMPYHAKNSLETLIRRHGPLDWRETLSIGVKLA
GALEAAHRVGTLHRDVKPGNILLTDYGEPQLTDFGIARIAGGFETATGVIAGSPAFTAPEVLEGASPTP
ASDVYSLGATLFCALTGHAAYERRSGERVIAQFLRITSQPIPDLRKQGLPADVAAAIERAMARHPADR
PATAADVGEELRDVQRRNGVSVDEMPLPVELGVERRRSPEAHAAHRHTGGGTPTVPTPPTPATKY
RPSVPTGSLVTRSRLTDILRAGGRRRLILIHAPSGFGKSTLAAQWREELSRDGAAVAWLTIDNDDNNE
VWFLSHLLESIRRVRPTLAESLGHVLEEHGDDAGRYVLTSLIDEIHENDDRIAVVIDDWHRVSDSRTQ
AALGFLLDNGCHHLQLIVTSWSRAGLPVGRLRIGDELAEIDSAALRFDTDEAAALLNDAGGLRLPRAD
VQALTTSTDGWAAALRLAALSLRGGGDATQLLRGLSGASDVIHEFLSENVLDTLEPELREFLLVASVT
ERTCGGLASALAGITNGRAMLEEAEHRGLFLQRTEDDPNWFRFHQMFADFLHRRLERGGSHRVAEL
HRRASAWFAENGYLHEAVDHALAAGDPARAVDLVEQDETNLPEQSKMTTLLAIVQKLPTSMVVSRA
RLQLAIAWANILLQRPAPATGALNRFETALGRAELPEATQADLRAEADVLRAVAEVFADRVERVDDLL
AEAMSRPDTLPPRVPGTAGNTAALAAICRFEFAEVYPLLDWAAPYQEMMGPFGTVYAQCLRGMAAR
NRLDIVAALQNFRTAFEVGTAVGAHSHAARLAGSLLAELLYETGDLAGAGRLMDESYLLGSEGGAVD
YLAARYVIGARVKAAQGDHEGAADRLSTGGDTAVQLGLPRLAARINNERIRLGIALPAAVAADLLAPR
TIPRDNGIATMTAELDEDSAVRLLSAGDSADRDQACQRAGALAAAIDGTRRPLAALQAQILHIETLAAT
GRESDARNELAPVATKCAELGLSRLLVDAGLA >Rv3106 fprA adrenodoxin and NADPH ferredoxin reductase TB.seq 3474004:3475371
MW:49342 SEQ ID NO:266
MRPYYIAIVGSGPSAFFAAASLLKAADTTEDLDMAVDMLEMLPTPWGLVRSGVAPDHPKIKSISKQFE
KTAEDPRFRFFGNVVVGEHVQPGELSERYDAVIYAVGAQSDRMLNIPGEDLPGSIAAVDFVGWYNA
HPHFEQVSPDLSGARAVVIGNGNVALDVARILLTDPDVLARTDIADHALESLRPRGIQEVVIVGRRGPL
QAAFTTLELRELADLDGVDVVIDPAELDGITDEDAAAVGKVCKQNIKVLRGYADREPRPGHRRMVFR
FLTSPIEIKGKRKVERIVLGRNELVSDGSGRVAAKDTGEREELPAQLVVRSVGYRGVPTPGLPFDDQ
SGTIPNVGGRINGSPNEYVVGWIKRGPTGVIGTNKKDAQDTVDTLIKNLGNAKEGAECKSFPEDHAD
QVADWLAARQPKLVTSAHWQVIDAFERAAGEPHGRPRVKLASLAELLRIGLG >Rv3235 - TB.seq 3611296:3611934 MW:22659 SEQ ID NO:267
MMASNQTAAQHSSATLQQAPRSIDDAGGCPLTISPIANSPGDTFAVTPVVEYEPPPRNIPPCGQSSH
AARRPHTPQLARRQPIRPSGRAPAAVTSTAKSPRLRQAGTFADAALRRVLEVIDRRRPVGQLRPLLA
PGLVDSVLAVSRTAAGHQQGAAMLRRIRLTPAGPDTADTAAEVFGTYSRGDRIHAIACRVEQRPAGN
ETRWLMVALHIG >Rv3255c manA mannose-6-phosphate isomerase TB.seq 3635040:3636263 MW:43340
SEQ ID NO:268
VELLRGALRTYAWGSRTAIAEFTGRPVPAAHPEAELWFGAHPGDPAWLQTPHGQTSLLEALVADPE
GQLGSASRARFGDVLPFLVKVLAADEPLSLQAHPSAEQAVEGYLREERMGIPVSSPVRNYRDTSHK
PELLVALQPFEALAGFREMRTTELLRALAVSDLDPFIDLLSEGSDADGLRALFTTWITAPQPDIDVLV
PAVLDGAIQYVSSGATEFGAEAKTVLELGERYPGDAGVLAALLLNRISLAPGEAIFLPAGNLHAYVRG
FGVEVMANSDNVLRGGLTPKHVDVPELLRVLDFAPTPKARLRPPIRREGLGLVFETPTDEFAATLLVL
DGDHLGHEVDASSGHDGPQILLCTEGSATVHGKCGSLTLQRGTAAWVAADDGPIRLTAGQPAKLFR
ATVGL >Rv3264c rmlA2 glucose-1-phosphate thymidyltransferase TB.seq 3644897:3645973 MW:37840
SEQ ID NO:269
LATHQVDAVVLVGGKGTRLRPLTLSAPKPMLPTAGLPFLTHLLSRIAAAGIEHVILGTSYKPAVFEAEF
GDGSALGLQIEYVTEEHPLGTGGGIANVAGKLRNDTAMVFNGDVLSGADLAQLLDFHRSNRADVTL
QLVRVGDPRAFGCVPTDEEDRVVAFLEKTEDPPTDQINAGCYVFERNVIDRIPQGREVSVEREVFPA
LLADGDCKIYGYVDASYWRDMGTPEDFVRGSADLVRGIAPSPALRGHRGEQLVHDGAAVSPGALLI
GGTVVGRGAEIGPGTRLDGAVIFDGVRVEAGCVIERSIIGFGARIGPRALIRDGVIGDGADIGARCELL
SGARVWPGVFLPDGGIRYSSDV >Rv3368c - TB.seq 3780334:3780975 MW:23734 SEQ ID NO:270
MTLNLSVDEVLTTTRSVRKRLDFDKPVPRDVLMECLELALQAPTGSNSQGWQWVFVEDAAKKKAIA
DVYLANARGYLSGPAPEYPDGDTRGERMGRVRDSATYLAEHMHRAPVLLIPCLKGREDESAVGGVS
FWASLFPAVWSFCLALRSRGLGSCWTTLHLLDNGEHKVADVLGIPYDEYSQGGLLPIAYTQGIDFRP
AKRLPAESVTHWNGW >Rv3382c lytB1 TB.seq 3796447:3797433 MW:34667 SEQ ID NO:271
MAEVFVGPVAQGYASGEVTVLLASPRSFCAGVERAIETVKRVLDVAEGPVYVRKQIVHNTVVVAELR
DRGAVFVEDLDEIPDPPPPGAVVVFSAHGVSPAVRAGADERGLQVVDATCPLVAKVHAEAARFAAR
GDTVVFIGHAGHEETEGTLGVAPRSTLLVQTPADVAALNLPEGTQLSYLTQTTLALDETADVIDALRA
RFPTLGQPPSEDICYATTNRQRALQSMVGECDVVLVIGSCNSSNSRRLVELAQRSGTPAYLIDGPDDI TABLE 4-continued

EPEWLSSVSTIGVTAGASAPPRLVGQVIDALRGYASITVVERSIATETVRFGLPKQVRAQ

>Rv3418c groES 10 kD chaperone TB.seq 3836985:3837284 MW:10773 SEQ ID NO:272
VAKVNIKPLEDKILVQANEAETTTASGLVIPDTAKEKPQEGTVVAVGPGRWDEDGEKRIPLDVAEGDT
VIYSKYGGTEIKYNGEEYLILSARDVLAVVSK >Rv3423c alr TB.seq 3840193:3841416 MW:43357 SEQ ID NO:273
VKRFWENVGKPNDTTDGRGTTSLAMTPISQTPGLLAEAMVDLGAIEHNVRVLREHAGHAQLMAVVK
ADGYGHGATRVAQTALGAGAAELGVATVDEALALRADGITAPVLAWLHPPGIDFGPALLADVQVAVS
SLRQLDELLHAVRRTGRTATVKVKVDTGLNRNGVGPAQFPAMLTALRQAMAEDAVRLRGLMSHMV
YADKPDDSINDVQAQRFTAFLAQAREQGVRFEVAHLSNSSATMARPDLTFDLVRPGIAVYGLSPVPA
LGDMGLVPAMTVKCAVALVKSIRAGEGVSYGHTWIAPRDTNLALLPIGYADGVFRSLGGRLEVLINGR
RCPGVGRICMDQFMVDLGPGPLDVAEGDEAILFGPGIRGEPTAQDWADLVGTIHYEVVTSPRGRITR
TYREAENR >Rv3490 otsA [alpha],-trehalose-phosphate synthase TB.seq 3908232:3909731 MW:55864
SEQ ID NO:274
MAPSGGQEAQICDSETFGDSDFVVVANRLPVDLERLPDGSTTWKRSPGGLVTALEPVLRRRRGAW
VGWPGVNDDGAEPDLHVLDGPIIQDELELHPVRLSTTDIAQYYEGFSNATLWPLYHDVIVKPLYHRE
WWDRYVDVNQRFAEAASRMAHGATVWVQDYQLQLVPKMLRMLRPDLTIGFFLHIPFPPVELFMQ
MPWRTEIIQGLLGADLVGFHLPGGAQNFLILSRRLVGTDTSRGTVGVRSRFGAAVLGSRTIRVGAFPI
SVDSGALDHAARDRNIRRRAREIRTELGNPRKILLGVDRLDYTKGIDVRLKAFSELLAEGRVKRDDTV
VVQLATPSRERVESYQTLRNDIERQVGHINGEYGEVGHPVVHYLHRPAPRDELIAFFVASDVMLVTP
LRDGMNLVAKEYVACRSDLGGALVLSEFTGAAAELRHAYLVNPHDLEGVKDGIEEALNQTEEAGRR
RMRSLRRQVLAHDVDRWAQSFLDALAGAHPRGQG >Rv3598c lysS lysyl-tRNA synthase TB.seq 4041423:4042937 MW:55678 SEQ ID NO:275
VSAADTAEDLPEQFRIRRDKRARLLAQGRDPYPVAVPRTHTLAEVRAAHPDLPIDTATEDIVGVAGRV
IFARNSGKLCFATLQDGDGTQLQVMISLDKVGQAALDAWKADVDLGDIVYVHGAVISSRRGELSVLA
DCWRIAAKSLRPLPVAHKEMSEESRVRQRYVDLIVRPEARAVARLRIAVVRAIRTALQRRGFLEVETP
VLQTLAGGMARPFATHSNALDIDLYLRIAPELFLKRCIVGGFDKVFELNRVFRNEGADSTHSPEFSM
LETYQTYGTYDDSAVVTRELIQEVADEAIGTRQLPLPDGSVYDIDGEWATIQMYPSLSVALGEEITPQT
TVDRLRGIADSLGLEKDPAIHDNRGFGHGKLIEELWERTVGKSLSAPTFVKDFPVQTTPLTRQHRSIP
GVTEKWDLYLRGIELATGYSELSDPVVQRERFADQARAAAAGDDEAMVLDEDFLAALEYGWPPCTG
TGMGIDRLLMSLTGLSIRETVLFPIVRPHSN >Rv3600c - similar to *Bacillus subtilis* protein YacB TB.seq 4043041:4043856 MW:29274
SEQ ID NO:276
VLLAIDVRNTHTVVGLLSGMKEHAKVVQQWRIRTESEVTADELALTIDGLIGEDSERLTGTAALSTVPS
VLHEVRIMLDQYWPSVPHVLIEPGVRTGIPLLVDNPKEVGADRIVNCLAAYDRFRKAAIVVDFGSSICV
DVVSAKGEFLGGAIAPGVQVSSDAAAARSAALRRVELARPRSVVGKNTVECMQAGAVFGFAGLVDG
LVGRIREDVSGFSVDHDVAIVATGHTAPLLLPELHTVDHYDQHLTLQGLRLVFERNLEVQRGRLKTAR >Rv3606c folK 7,8-dihydro-6-hydroxymethylpterin pyrophosphokinase TB.seq
4048181:4048744 MW:20732 SEQ ID NO:277
MTRVVLSVGSNLGDRLARLRSVADGLGDALIAASPIYEADPWGGVEQGQFLNAVLIADDPTCEPREW
LRRAQEFERAAGRVRGQRWGPRNLDVDLIACYQTSATEALVEVTARENHLTLPHPLAHLRAFVLIPW
IAVDPTAQLTVAGCPRPVTRLLAELEPADRDSVRLFRPSFDLNSRHPVSRAPES >Rv3607c folX may be involved in folate biosynthesis TB.seq 4048744:4049142 MW:14553
MADRIELRGLTVHGRHGVYDHERVAGQRFVIDVTVWIDLAEAANSDDLADTYDYVRLASRAAEIVAG
PPRKLIETVGAEIADHVMDDQRVHAVEVAVHKPQAPIPQTFDDVAVVIRRSRRGGRGWVVPAGGAV >Rv3608c folP dihydropteroate synthase TB.seq 4049138:4049977 MW:28812 SEQ ID NO:278
VSPAPVQVMGVLNVTDDSFSDGGCYLDLDDAVKHGLAMMAGAGIVDVGGESSRPGATRVDPAVE
TSRVIPWKELAAQGITVSIDTMRADVARAALQNGAQMVNDVSGGRADPAMGPLLAEADVPWVLMH
WRAVSADTPHVPVRYGNVVAEVRADLLASVADAVAAGVDPARLVLDPGLGFAKTAQHNWAILHALP
ELVATGIPVLVGASRKRFLGALLAGPDGVMRPTDGRDTATAVISALAALHGAWGVRVHDVRASVDAI
KVVEAWMGAERIERDG >Rv3609c folE GTP cyclohydrolase I TB.seq 4049977:4050582 MW:22395 SEQ ID NO:279
MSQLDSRSASARIRVFDQQRAEAAVRELLYAIGEDPDRDGLVATPSRVARSYREMFAGLYTDPDSVL
NTMFDEDHDELVLVKEIPMYSTCEHHLVAFHGVAHVGYIPGDDGRVTGLSKIARLVDLYAKRPQVQE
RLTSQIADALMKKLDPRGVIVVIEAEHLCMAMRGVRKPGSVTTTSAVRGLFKTNAASRAEALDLILRK >Rv3610c ftsH inner membrane protein, chaperone TB.seq 4050601:4052880 MW:81987
MNRKNVTRTITAIAVVVLLGWSFFYFSDDTRGYKPVDTSVAITQINGDNVKSAQIDDREQQLRLILKKG
NNETDGSEKVITKYPTGYAVDLFNALSAKNAKVSTVVNQGSILGELLVYVLPLLLLVGLFVMFSRMQG
GARMGFGFGKSRAKQLSKDMPKTTFADVAGVDEAVEELYEIKDFLQNPSRYQALGAKIPKGVLLYGP
PGTGKTLLARAVAGEAGVPFFTISGSDFVEMFVGVGASRVRDLFEQAKQNSPCIIFVDEIDAVGRQR
GAGLGGGHDEREQTLNQLLVEMDGFGDRAGVILIAATNRPDILDPALLRPGRFDRQIPVSNPDLAGR
RAVLRVHSKGKPMAADADLDGLAKRTVGMTGADLANVINEAALLTARENGTVITGPALEEAVDRVIG
GPRRKGRIISEQEKKITAYHEGGHTLAAWAMPDIEPIYKVTILARGRTGGHAVAVPEEDKGLRTRSEMI
AQLVFAMGGRMEELVFREPTTGAVSDIEQATKIARSMVTEFGMSSKLGAVKYGSEHGDPFLGRTM
GTQPDYSHEVAREIDEEVRKLIEAAHTEAWEILTEYRDVLDTLAGELLEKETLHRPELESIFADVEKRP
RLTMFDDFGGRIPSDKPPIKTPGELAIERGEPWPQPVPEPAFKAAIAQATQAAEAARSDAGQTGHGA
NGSPAGTHRSGDRQYGSTQPDYGAPAGWHAPGWPPRSSHRPSYSGEPAPTYPGQPYPTGQADP
GSDESSAEQDDEVSRTKPAHG TABLE 4-continued

```
>Rv3671c - TB.seq 4112322:4113512 MW:40722 SEQ ID NO:280
MTPSQWLDIAVLAVAFIAAISGWRAGALGSMLSFGGVLLGATAGVLLAPHIVSQISAPRAKLFAALFLIL
ALVVVGEVAGVVLGRAVRGAIRNRPIRLIDSVIGVGVQLVVVLTAAWLLAMPLTQSKEQPELAAAVKG
SRVLARVNEAAPTWLKTVPKRLSALLNTSGLPAVLEPFSRTPVIPVASPDPALVNNPVVAATEPSVVKI
RSLAPRCQKVLEGTGFVISPDRVMTNAHVVAGSNNVTVYAGDKPFEATVVSYDPSVDVAILAVPHLP
PPPLVFAAEPAKTGADVVVLGYPGGGNFTATPARIREAIRLSGPDIYGDPEPVTRDVYTIRADVEQGD
SGGPLIDLNGQVLGVVFGAAIDDAETGFVLTAGEVAGQLAKIGATQPVGTGACVS

>Rv3682 ponA2 TB.seq 4121913:4124342 MW:84637 SEQ ID NO:281
MPERLPAAITVLKLAGCCLLASVVATALTFPFAGGLGLMSNRASEVVANGSAQLLEGQVPAVSTMVD
AKGNTIAWLYSQRRFEVPSDKIANTMKLAIVSIEDKRFADHSGVDWKGTLTGLAGYASGDLDTRGGS
TLEQQYVKNYQLLVTAQTDAEKRAAVETTPARKLREIRMALTLDKTFTKSEILTRYLNLVSFGNNSFG
VQDAAQTYFGINASDLNWQQAALLAGMVQSTSTLNPYTNPDGALARRNVVLDTMIENLPGEAEALR
AAKAEPLGVLPQPNELPRGCIAAGDRAFFCDYVQEYLSRAGISKEQVATGGYLIRTTLDPEVQAPVKA
AIDKYASPNLAGISSVMSVIKPGKDAHKVLAMASNRKYGLDLEAGETMRPQPFSLVGDGAGSIFKIFT
TAAALDMGMGINAQLDVPPRFQAKGLGSGGAKGCPKETWCVVNAGNYRGSMNVTDALATSPNTAF
AKLISQVGVGRAVDMAIKLGLRSYANPGTARDYNPDSNESLADFVKRQNLGSFTLGPIELNALELSNV
AATLASGGVWCPPNPIDQLIDRNGNEVAVTTETCDQVVPAGLANTLANAMSKDAVGSGTMGSAGA
AGWDLPMSGKTGTTEAHRSAGFVGFTNRYAAANYIYDDSSSPTDLCSGPLRHCGSGDLYGGNEPS
RTWFAAMKPIANNFGEVQLPPTDPRYVDGAPGSRVPSVAGLDVDAARQRLKDAGFQVADQTNSVN
SSAKYGEVVGTSPSGQTIPGSIVTIQISNGIPPAPPPPPLPEDGGPPPPVGSQVVEIPGLPPITIPLLAP
PPPAPPP

>Rv3721c dnaZX DNA polymerase III,[gamma] (dnaZ) and t (dnaX) TB.seq 4164995:4166728
MW:61892 SEQ ID NO:282
VALYRKYRPASFAEVVGQEHVTAPLSVALDAGRINHAYLFSGPRGCGKTSSARILARSLNCAQGPTA
NPCGVCESCVSLAPNAPGSIDVVELDAASHGGVDDTRELRDRAFYAPVQSRYRVFIVDEAHMVTTA
GFNALLKIVEEPPEHLIFIFATTEPEKVLPTIRSRTHHYPFRLLPPRTMRALLARICEQEGVVVDDAVYP
LVIRAGGGSPRDTLSVLDQLLAGMDTHVTTTRALGLLGVTDVALIDDAVDALAACDAAALFGAIESVI
DGGHDPRRFATDLLERFRDLIVLQSVPDAASRGVVDAPEDALDRMREQAARIGRATLTRYAEVVQA
GLGEMRGATAPRLLLEVVCARLLLPSASDAESALLQRVERETRLDMSIPAPQAVPRPSAAAAEPKHQ
PAREPRPVLAPTPASSEPTVAAVRSMWPTVRDKVRLRSRTTEVMLAGATVRALEDNTLVLTHESAPL
ARRLSEQRNADVLAEALKDALGVNWRVRCETGEPAAAASPVGGGANVATAKAVNPAPTANSTQRD
EEEHMLAEAGRGDPSPRRDPEEVALELLQNELGARRIDNA

>Rv3783 - TB.seq 4229255:4230094 MW:32337 SEQ ID NO:283
MTFMDAQASFQTQSRTLARVRGDLVDGFRRHELWLHLGWQDIKQRYRRSVLGPFWITIATGTTAVA
MGGLYSKLFRLELSEHLPYVVTLGLIVWNLINAAILDGAEVFVANEGLKQLPAPLSVHVYRLVWRQMIF
FAHNIVIYFVIAIFPKPWSWADLSFLPALALIFLNCVWVSLCFGILATRYRDIGPLLFSVVQLLFFMTPII
WNDETLRRQGAGRWSSIVELNPLLHYLDIVRAPLLGAHQELRHWLVVLVLTVVGWMLAAFAMRQYR
ARVPYWV

>Rv3789 - TB.seq 4235371:4235733 MW:13378 SEQ ID NO:284
MRFVVTGGLAGIVDFGLYVVLYKVAGLQVDLSKAISFIVGTITAYLINRRWTFQAEPSTARFVAVMLLY
GITFAVQVGLNHLCLALLHYRAWAIPVAFVIAQGTATVINFWQRAVIFRIR

>Rv3790 - TB.seq 4235776:4237158 MW:50164 SEQ ID NO:285
MLSVGATTTATRLTGWGRTAPSVANVLRTPDAEMIVKAVARVAESGGGRGAIARGLGRSYGDNAQN
GGGLVIDMTPLNTIHSIDADTKLVDIDAGVNLDQLMKAALPFGLWVPVLPGTRQVTVGGAIACDIHGK
NHHSAGSFGNHVRSMDLLTADGEIRHLTPTGEDAELFWATVGGNGLTGIIMRATIEMTPTSTAYFIAD
GDVTASLDETIALHSDGSEARYTYSSAWFDAISAPPKLGRAAVSRGRLATVEQLPAKLRSEPLKFDAP
QLLTLPDVFPNGLANKYTFGPIGELWYRKSGTYRGKVQNLTQFYHPLDMFGEWNRAYGPAGFLQYQ
FVIPTEAVDEFKKIIGVIQASGHYSFLNVFKLFGPRNQAPLSFPIPGWNICVDFPIKDGLGKFVSELDRR
VLEFGGRLYTAKDSRTTAETFHAMYPRVDEWISVRRKVDPLRVFASDMARRLELL

>Rv3791 - TB.seq 4237162:4237923 MW:27470 SEQ ID NO:286
MVLDAVGNPQTVLLLGGTSEIGLAICERYLHNSAARIVLACLPDDPRREDAAAAMKQAGARSVELIDF
DALDTDSHPKMIEAAFSGGDVDVAIVAFGLLGDAEELWQNQRKAVQIAEINYTAAVSVGVLLAEKMR
AQGFGQIIAMSSAAGERVRRANFVYGSTKAGLDGFYLGLSEALREYGVRVLVIRPGQVRTRMSAHLK
EAPLTVDKEYVANLAVTASAKGKELVWAPAAFRWMMVLRHIPRSIFRKLPI

>Rv3794 embA TB.seq 4243230:4246511 MW:115694 SEQ ID NO:287
VPHDGNERSHRIARLAAVVSGIAGLLLCGIVPLLPVNQTTATIFWPQGSTADGNITQITAPLVSGAPRA
LDISIPCSAIATLPANGGLVLSTLPAGGVDTGKAGLFVRANQDTVVVAFRDSVAAVAARSTIAAGGCS
ALHIWADTGGAGADFMGIPGGAGTLPPEKKPQVGGIFTDLKVGAQPGLSARVDIDTRFITTPGALKKA
VMLLGVLAVLVAMVGLAALDRLSRGRTLRDWLTRYRPRVRVGFASRLADAAVIATLLLWHVIGATSS
DDGYLLTVARVAPKAGYVANYYRYFGTTEAPFDWYTSVLAQLAAVSTAGVWMRLPATLAGIACWLIV
SRFVLRRLGPGPGGLASNRVAVFTAGAVFLSAWLPFNNGLRPEPLIALGVLVTWVLVERSIALGRLAP
AAVAIIVATLTATLAPQGLIALAPLLTGARAIAQRIRRRRATDGLLAPLAVLAAALSLITVVVFRDQTLATV
AESARIKYKVGPTIAWYQDFLRYYFLTVESNVEGSMSRRFAVLVLLFCLFGVLFVLLRRGRVAGLASG
PAWRLIGTTAVGLLLLTFTPTKWAVQFGAFAGLAGVLGAVTAFTFARIGLHSRRNLTLYVTALLFVLA
WATSGINGWFWGNYGVPWYDIQPVIASHPVTSMFLTLSILTGLLAAWYHFRMDYAGHTEVKDNRR
NRILASTPLLVVAVIMVAGEVGSMAKAAVFRYPLYTTAKANLTALSTGLSSCAMADDVLAEPDPNAGM
LQPVPGQAFGPDGPLGGISPVGFKPEGVGEDLKSDPVVSKPGLVNSDASPNKPNAAITDSAGTAGG
KGPVGINGSHAALPFGLDPARTPVMGSYGENNLAATATSAWYQLPPRSPDRPLVVVSAAGAIWSYK
EDGDFIYGQSLKLQWGVTGPDGRIQPLGQVFPIDIGPQPAWRNLRFPLAWAPPEADVARIVAYDPNL
SPEQWFAFTPPRVPVLESLQRLIGSATPVLMDIATAANFPCQRPFSEHLGIAELPQYRILPDHKQTAA
SSNLWQSSSTGGPFLFTQALLRTSTIATYLRGDWYRDWGSVEQYHRLVPADQAPDAVVEEGVITVP
GWGRPGPIRALP
```

TABLE 4-continued

```
>Rv3795 embB TB.seq 4246511:4249804 MW:118023 SEQ ID NO:288
MTQCASRRKSTPNRAILGAFASARGTRWVATIAGLIGFVLSVATPLLPVVQTTAMLDWPQRGQLGSV
TAPLISLTPVDFTATVPCDVVRAMPPAGGVVLGTAPKQGKDANLQALFVVVSAQRVDVTDRNVVILS
VPREQVTSPQCQRIEVTSTHAGTFANFVGLKDPSGAPLRSGFPDPNLRPQIVGVFTDLTGPAPPGLA
VSATIDTRFSTRPTTLKLLAIIGAIVATVVALIALWRLDQLDGRGSIAQLLLRPFRPASSPGGMRRLIPAS
WRTFTLTDAVVIFGFLLWHVIGANSSDDGYILGMARVADHAGYMSNYFRWFGSPEDPFGWYYNLLA
LMTHVSDASLWMRLPDLAAGLVCWLLLSREVLPRLGPAVEASKPAYWAAAMVLLTAWMPFNNGLR
PEGIIALGSLVTYVLIERSMRYSRLTPAALAVVTAAFTLGVQPTGLIAVAALVAGGRPMLRILVRRHRLV
GTLPLVSPMLAAGTVILTVVFADQTLSTVLEATRVRAKIGPSQAWYTENLRYYYLILPTVDGSLSRRFG
FLITALCLFTAVFIMLRRKRIPSVARGPAWRLMGVIFGTMFFLMFTPTKWVHHFGLFMVGAAMAALT
TVLVSPSVLRWSRNRMAFLAALFFLLALCWATTNGWWYVSSYGVPFNSAMPKIDGITVSTIFFALFAI
AAGYAAWLHFAPRGAGEGRLIRALTTAPVPIVAGFMAAVFVASMVAGIVRQYPTYSNGWSNVRAFV
GGCGLADDVLVEPDTNAGFMKPLDGDSGSWGPLGPLGGVNPVGFTPNGVPEHTVAEAIVMKPNQP
GTDYDWDAPTKLTSPGINGSTVPLPYGLDPARVPLAGTYTTGAQQQSTLVSAWYLLPKPDDGHPLV
VVTAAGKIAGNSVLHGYTPGQTVVLEYAMPGPGALVPAGRMVPDDLYGEQPKAWRNLRFARAKMP
ADAVAVRVVAEDLSLTPEDWIAVTPPRVPDLRSLQEYVGSTQPVLLDWAVGLAFPCQQPMLHANGIA
EIPKFRITPDYSAKKLDTDTWEDGTNGGLLGITDLLLRAHVMATYLSRDWARDWGSLRKFDTLVDAP
PAQLELGTATRSGLWSPGKIRIGP

>Rv3834c serS seryl-tRNA synthase TB.seq 4307655:4308911 MW:45293 SEQ ID NO:289
VIDLKLLRENPDAVRRSQLSRGEDPALVDALLTADAARRAVISTADSLRAEQKAASKSVGGASPEERP
PLLRRAKELAEQVKAAEADEVEAEAAFTAAHLAISNVIVDGVPAGGEDDYAVLDAAGEPSYLENPKD
HLELGESLGLIDMQRGAKVSGSRFYFLTGRGALLQLGLLQLALKLAVDNGFVPTIPPVLVRPEVMVGT
GFLGAHAEEVYRVEGDGLYLVGTSEVPLAGYHSGEILDLSRGPLRYAGWSSCFRREAGSHGKDTRG
IIRVHQFDKVEGFVYCTPADAEHEHERLLGWQRQMLARIEVPYRVIDVAAGDLGSSAARKFDCEAWI
PTQGAYRELTSTSNCTTFQARRLATRYRDASGKPQIAATLNGTLATTRWLVAILENHQRPDGSVRVP
DALVPFVGVEVLEPVA

>Rv3907c pcnA polynucleotide polymerase TB.seq 4391631:4393070 MW:53057 SEQ ID NO:290
VPEAVQEADLLTAAAVALNRHAALLRELGSVFAAAGHELYLVGGSVRDALLGRLSPDLDFTTDARPE
RVQEIVRPWADAVWDTGIEFGTVGVGKSDHRMEITTFRADSYDRVSRHPEVRFGDCLEGDLVRRDF
TTNAMAVRVTATGPGEFLDPLGGLAALRAKVLDTPAAPSGSFGDDPLRMLRAARFVSQLGFAVAPR
VRAAIEEMAPQLARISAERVAAELDKLLVGEDPAAGIDLMVQSGMGAVVLPEIGGMRMAIDEHHQHK
DVYQHSLTVLRQAIALEDDGPDLVLRWAALLHDIGKPATRRHEPDGGVSFHHHEVVGAKMVRKRMR
ALKYSKQMIDDISQLVYLHLRFHGYGDGKWTDSAVRRYVTDAGALLPRLHKLVRADCTTRNKRRAAR
LQASYDRLEERIAELAAQEDLDRVRPDLDGNQIMAVLDIPAGPQVGEAWRYLKELRLERGPLSTEEA
TTELLSWWKSRGNR
```

A number of embodiments of the invention have been described. Nevertheless, it will be understood that various modifications may be made without departing from the spirit and scope of the invention. Accordingly, other embodiments are within the scope of the following claims.

SEQUENCE LISTING (292 sequences)

SEQ ID NO: 1 - DNA, 1209 bp, Mycobacterium tuberculosis
atggacgcggctacgacaagagttggcctcaccgacttgacgtttcgtttgctacgagagtctttcgccgatgcggtgtcgtgggtggctaaaaatctgccagccaggcccgcggtgccggtgctctccggcgtgttgttgaccggctcggacaacggtctgacgatttccggattcgactacgaggtttccgccgaggcccaggttggcgctgaaattgtttctcctggaagcgttttagtttctggccgattgttgtccgatattacccgggcgttgcctaacaagcccgtagacgttcatgtcgaaggtaaccgggtcgcattgacctgcggtaacgccaggttttcgctaccgacgatgccagtcgaggattatccgacgctgccgacgctgccggaagagaccggattgttgcctgcggaattattcgccgaggcaatcagtcaggtcgctatcgccgccggccgggacgacacgttgcctatgttgaccggcatccgggtcgaaatcctcggtgagacggtggttttggccgctaccgacaggtttcgcctggctgttcgagaactgaagtggtcggcgtcgtcgccagatatcgaagcggctgtgctggtcccggccaagacgctggccgaggccgccaaagcgggcatcggcggctctgacgttcgtttgtcgttgggtactgggccgggggtgggcaaggatggcctgctcggtatcagtgggaacggcaagcgcagcaccacgcgacttcttgatgccgagttcccgaagtttcggcagttgctaccaaccgaacacaccgcggtggccaccatggacgtggccgagttgatcgaagcgatcaagctggttgcgttggtagctgatcggggcgcgcaggtgcgcatggagttcgctgatggcagcgtgcggctttctgcgggtgccgatgatgttggacgagccgaggaagatcttgttgttgactatgccggtgaaccattgacgattgcgtttaacccaacctatctaacggacggtttgagttcgttgcgctcggagcgagtgtctttcgggtttacgactgcgggtaagcctgccttgctacgtccggtgtccggggacgatcgccctgtggcgggtctgaatggcaacggtccgttcccggcggtgtcgacggactatgtctatctgttgatgccggttcggttgccgggctga

SEQ ID NO: 2 - DNA, 1158 bp, Mycobacterium tuberculosis
gtgtacgtccgtcatttggggctgcgtgacttccggtcctgggcatgtgtagatctggaattgcatccagggcggacggtttttgttgggcctaacggttatggtaagacgaatcttattgaggcactgtggtattcgacgacgttaggttcgcaccgcgttagcgccgatttgccgttgatccgggtaggtaccgatcgtgcggtgatctccacgatcgtggtgaacgacggtagagaatgtgccgtcgacctcgagatcgccacggggcgagtcaacaaagcgcgattgaatcgatcatcggtccgaagtacacgtgatgtggtcggagtgcttcgagctgtgttgtttgcccctgaggatctggggttggttcgtggggatcccgctgaccggcggcgctatctggatgatctggcgatcgtgcgtaggcctgcgatcgctgcggtacgagccgaatatgagagggtgttgcgccagcggacggcgttattgaagtccgtacctggagcacggtatcggggtgaccggggtgtgtttgacactcttgaggtatgggacagtcgtttggcggagcacggggctgaactggtggccgcccgcatcgatttggtcaaccagttggcaccggaagtgaagaaggcataccagctgttggcgccggaatcgcgatcggcgtctatcggttatcgggccagcatggatgtaaccggtcccagcgagcagtcagatatcgatcggcaattgttagcagctcggctgttggcggcgctggcggcccgtcgggatgccgaactcgagcgtggggtttgtctagttggtccgcaccgtgacgacctaatactgcgactaggcgatcaacccgcgaaaggatttgctagccatggggaggcgtggtcgttggcggtggcactgcggttggcggcctatcaactgttacgcgttgatggtggtgagccggtgttgttgctcgacgacgtgttcgccgaactggatgtcatgcgccgtcgagcgttggcgacggcggccgagtccgccgaacaggtgttggtgactgccgcggtgctcgaggatattcccgccggctgggacgccaggcgggtgcacatcgatgtgcgtgccgatgacaccggatcgatgtcggtggttctgccatga

SEQ ID NO: 3 - DNA, 2145 bp, Mycobacterium tuberculosis
atgggtaaaaacgaggccagaagatcggccctggcgcccgatcacggtacagtggtgtgcgaccccctgcggcgactcaaccgcatgcacgcaacccctgaggagagtattcggatcgtggctgcccagaaaaagaaggcccaagacgaatacggcgctgcgtctatcaccattctcgaagggctggaggccgtccgcaaacgtcccggcatgtacattggctcgaccggtgagcgcggtttacaccatctcatttgggaggtggtcgacaacgcggtcgacgaggcgatggccggttatgcaaccacagtgaacgtagtgctgcttgaggatggcggtgtcgaggtcgccgacgacggccgcggcattccggtcgccacccacgcctccggcataccgaccgtcgacgtggtgatgacacaactacatgccggcggcaagttcgactcggacgcgtatgcgatatctggtggtctgcacggcgtcggcgtgtcggtggttaacgcgctatccacccggctcgaagtcgagatcaagcgcgacgggtacgagtggtctcaggtttatgagaagtcggaacccctgggcctcaagcaaggggcgccgaccaagaagacggggtcaacggtgcggttctgggccgaccccgctgttttcgaaaccacggaatacgacttcgaaaccgtcgcccgccggctgcaagagatggcgttcctcaacaaggggctgaccatcaacctgaccgacgagagggtgacccaagacgaggtcgtcgacgaagtggtcagcgacgtcgccgaggcgccgaagtcggcaagtgaacgcgcagccgaatccactgcaccgcacaaagttaagagccgcacctttcactatccgggtggcctggtggacttcgtgaaacacatcaaccgcaccaagaacgcgattcatagcagcatcgtggacttttccggcaagggcaccgggcacgaggtggagatcgcgatgcaatggaacgccgggtattcggagtcggtgcacaccttcgccaacaccatcaacacccacgagggcggcacccacgaagagggcttccgcagcgcgctgacgtcggtggtgaacaagtacgccaaggaccgcaagctactgaaggacaaggaccccaacctcaccggtgacgatatccgggaaggcctggccgctgtgatctcggtgaaggtcagcgaaccgcagttcgagggccagaccaagaccaagttgggcaacaccgaggtcaaatcgtttgtgcagaaggtctgtaacgaacagctgacccactggtttgaagccaaccccaccgacgcgaaagtcgttgtgaacaaggctgtgtcctcggcgcaagcccgtatcgcggcacgtaaggcacgagagttggtgcggcgtaagagcgccaccgacatcggtggattgcccggcaagctggccgattgccgttccacggatccgcgcaagtccgaactgtatgtcgtagaaggtgactcggccggcggttctgcaaaaagcggtcgcgattcgatgttccaggcgatacttccgctgcgcggcaagatcatcaatgtggagaaagcgcgcatcgaccgggtgctaaagaacaccgaagttcaggcgatcatcacggcgctgggcaccgggatccacgacgagttcgatatcggcaagctgcgctaccacaagatcgtgctgatggccgacgccgatgttgacggccaacatatttccacgctgttgttgacgttgttgttccggttcatgcggccgctcatcgagaacgggcatgtgtttttggcacaaccgccgctgtacaaactcaagtggcagcgcagtgacccggaattcgcatactccgaccgcgagcgcgacggtctgctggaggcggggctgaaggccgggaagaagatcaacaaggaagacggcattcagcggtacaagggtctaggtgaaatggacgctaaggagttgtgggagaccaccatggatccctcggttcgtgtgttgcgtcaagtgacgctggacgacgccgccgccgccgacgagttgttctccatcctgatgggcgaggacgtcgacgcgcggcgcagctttatcacccgcaacgccaaggatgttcggttcctggatgtctaa

SEQ ID NO: 4 - DNA, 2517 bp, Mycobacterium tuberculosis
atgacagacacgacgttgccgcctgacgactcgctcgaccggatcgaaccggttgacatcgagcaggagatgcagcgcagctacatcgactatgcgatgagcgtgatcgtcggccgcgcgctgccggaggtgcgcgacgggctcaagcccgtgcatcgccgggtgctctatgcaatgttcgattccggcttccgcccggaccgcagccacgccaagtcggcccggtcggttgccgagaccatgggcaactaccacccgcacggcgacgcgtcgatctacgacagcctggtgcgcatggcccagccctggtcgctgcgctacccgctggtggacggccagggcaacttcggctcgccaggcaatgacccaccggcggcgatgaggtacaccgaagcccggctgaccccgttggcgatggagatgctgagggaaatcgacgaggagacagtcgatttcatccctaactacgacggccgggtgcaagagccgacggtgctacccagccggttccccaacctgctggccaacgggtcaggcggcatcgcggtcggcatggcaaccaatatcccgccgcacaacctgcgtgagctggccgacgcggtgttctgggcgctggagaatcacgacgccgacgaagaggagaccctggccgcggtcatggggcgggttaaaggcccggacttcccgaccgccggactgatcgtcggatcccagggcaccgctgatgcctacaaaactggccgcggctccattcgaatgcgcggagttgttgaggtagaagaggattcccgcggtcgtacctcgctggtgatcaccgagttgccgtatcaggtcaaccacgacaacttcatcacttcgatcgccgaacaggtccgagacggcaagctggccggcatttccaacattgaggaccagtctagcgatcgggtcggtttacgcatcgtcatcgagatcaagcgcgatgcggtggccaaggtggtgatcaataacctttacaagcacacccagctgcagaccagctttggcgccaacatgctagcgatcgtcgacggggtgccgcgcacgctgcggctggaccagctgatccgctattacgttgaccaccaactcgacgtcattgtgcggcgcaccacctaccggctgcgcaaggcaaacgagcgagcccacattctgcgcggcctggttaaagcgctcgacgcgctggacgaggtcattgcactgatccgggcgtcggagaccgtcgatatcgcccgggccggactgatcgagctgctcgacatcgacgagatccaggcccaggcaatcctggacatgcagttgcggcgcctggccgcactggaacgccagcgcatcatcgacgacctggccaaaatcgaggccgagatcgccgatctggaagacatcctggcaaaacccgagcggcagcgtgggatcgtgcgcgacgaactcgccgaaatcgtggacaggcacggcgacgaccggcgtacccggatcatcgcggccgacggagacgtcagcgacgaggatttgatcgcccgcgaggacgtcgttgtcactatcaccgaaacgggatacgccaagcgcaccaagaccgatctgtatcgcagccagaaacgcggcggcaagggcgtgcagggtgcggggttgaagcaggacgacatcgtcgcgcacttcttcgtgtgctccacccacgatttgatcctgttcttcaccacccagggacgggtttatcgggccaaggcctacgacttgcccgaggcctcccggacggcgcgcgggcagcacgtggccaacctgttagccttccagcccgaggaacgcatcgcccaggtcatccagattcgcggctacaccgacgccccgtacctggtgctggccactcgcaacgggctggtgaaaaagtccaagctgaccgacttcgactccaatcgctcgggcggaatcgtggcggtcaacctgcgcgacaacgacgagctggtcggtgcggtgctgtgttcggccggcgacgacctgctgctggtctcggccaacgggcagtccatcaggttctcggcgaccgacgaggcgctgcggccaatgggtcgtgccacctcgggtgtgcagggcatgcggttcaatatcgacgaccggctgctgtcgctgaacgtcgtgcgtgaaggcacctatctgctggtggcgacgtcagggggctatgcgaaacgtaccgcgatcgaggaatacccggtacagggccgcggcggtaaaggtgtgctgacggtcatgtacgaccgccggcgcggcaggttggttggggcgttgattgtcgacgacgacagcgagctgtatgccgtcacttccggcggtggcgtgatccgcaccgcggcacgccaggttcgcaaggcgggacggcagaccaagggtgttcggttgatgaatctgggcgagggcgacacactgttggccatcgcgcgcaacgccgaagaaagtggcgacgataatgccgtggacgccaacggcgcagaccagacgggcaattaa

SEQ ID NO: 5 - DNA, 1881 bp, Mycobacterium tuberculosis
atgaccaccccttcccacctgtccgaccgctacgaacttggcgaaatccttggatttgggggcatgtccgaggtccacctggcccgcgacctccggttgcaccgcgacgttgcggtcaaggtgctgcgcgctgatctagcccgcgatcccagtttttaccttcgcttccggcgtgaggcgcaaaacgccgcggcattgaaccaccctgcaatcgtcgcggtctacgacaccggtgaagccgaaacgcccgccgggccattgccctacatcgtcatggaatacgtcgacggcgttaccctgcgcgacattgtccacaccgaagggccgatgacgcccaaacgcgccatcgaggtcatcgccgacgcctgccaagcgctgaacttcagtcatcagaacggaatcatccaccgtgacgtcaagccggcgaacatcatgatcagcgcgaccaatgcagtaaaggtgatggatttcggcatcgcccgcgccattgccgacagcggcaacagcgtgacccagaccgcagcagtgatcggcacggcgcagtacctgtcacccgaacaggcccggggtgattccgtcgacgcccgatccgatgtctattccttgggctgtgttctttatgaagtcctcaccggggagccacctttcaccggcgactcacccgtctcggttgcctaccaacatgtgcgcgaagacccgatcccaccttcggcgcggcacgaaggcctctccgccgacctggacgccgtcgttctcaaggcgctggccaaaaatccggaaaaccgctatcagacagcggcggagatgcgcgccgacctggtccgcgtgcacaacggtgagccgcccgaggcgcccaaagtgctcaccgatgccgagcggacctcgctgctgtcgtctgcggccggcaaccttagcggtccgcgcaccgatccgctaccacgccaggacttagacgacaccgaccgtgaccgcagcatcggttcggtgggccgttgggttgcggtggtcgccgtgctcgctgtgctgaccgtcgtggtaaccatcgccatcaacacgttcggcggcatcacccgcgacgttcaagttcccgacgttcggggtcaatcctccgccgacgccatcgccacactgcaaaaccggggcttcaaaatccgcaccttgcagaagccggactcgacaatcccaccggaccacgttatcggcaccgacccggccgccaacacgtcggtgagtgcaggcgacgagatcacagtcaacgtgtccaccggacccgagcaacgcgaaatacccgacgtctccacgctgacatacgccgaagcggtcaagaaactgactgccgccggattcggccgcttcaagcaagcgaattcgccgtccaccccggaactggtgggcaaggtcatcgggaccaacccgccagccaaccagacgtcggccatcaccaatgtggtcatcatcatcgttggctctggtccggcgaccaaagacattcccgatgtcgcgggccagaccgtcgacgtggcgcagaagaacctcaacgtctacggcttcaccaaattcagtcaggcctcggtggacagcccccgtcccgccggcgaggtgaccggcaccaatccacccgcaggcaccacagttccggtcgattcagtcatcgaactacaggtgtccaagggcaaccaattcgtcatgcccgacctatccggcatgttctgggtcgacgccgaaccacgattgcgcgcgctgggctggaccgggatgctcgacaaaggggccgacgtcgacgccggtggctcccaacacaaccgggtcgtctatcaaaacccgccggcggggaccggcgtcaaccgggacggcatcatcacgctgaggttcggccagtga

SEQ ID NO: 6 - DNA, 1476 bp, Mycobacterium tuberculosis
atgaacgcctctctgcgccgaatatcggtgaccgtgatggcgttgatcgtgttgctactgctcaacgcgaccatgacgcaggtcttcaccgccgacgggctgcgtgccgatccccgcaaccagcgagtgttgctcgacgagtattcacggcagcgcggccagatcaccgctggtggccaactgctggcgtactcggtagccaccgacggccgctttcgtttcctgcgggtctatcccaatcctgaggtgtacgcgccggttaccggcttctactccctgcgctattccagcaccgccctagaacgagccgaggacccgatattgaacgggtccgaccgccgtctgttcggccgccggctggccgacttcttcaccggtcgcgacccacgcggcggtaatgtcgataccacgatcaacccgcgcattcagcaagccggctgggacgcgatgcagcaaggctgctacgggccctgtaagggagcggtggtcgcccttgagccatcaaccggcaagattttggcgttggtgtcttctccgtcctacgaccccaacctgctggcgtcgcataaccccgaggtgcaggcgcaagcctggcagcggcttggcgacaatcccgcctctccactgaccaaccgtgccatctctgagacgtatccaccgggttcgactttcaaagtgatcaccactgcggccgcgctggccgccggggccaccgagaccgaacagctgactgcggcgcccacaattccgttgccaggcagcaccgcccagctagagaactacggcggtgcgccgtgcggggacgaacccaccgtgtcgctgcgtgaggcattcgtcaaatcatgcaacaccgcattcgtccagctgggcatccgcaccggcgccgacgccctgcgcagcatggcgcgcgcgttcggtctcgatagcccaccgcgcccaactccgctgcaagtggcggaatcaaccgtcgggcctatcccggacagcgccgcactagggatgaccagtatcggccaaaaggacgttgcgctgaccccgctagcgaacgcagaaatagccgcgaccatcgcaaacggcggcattacgatgaggccttatctagtcggcagcctcaagggaccggacctagccaatatctcaaccaccgtcggataccagcagcgccgcgcggtgtcaccgcaggtcgccgctaagctaacagagctgatggtcggcgccgagaaagtcgcacagcagaaaggggcaatccccggcgtgcagatcgcatccaagacgggcaccgccgaacatggcaccgaccctcgtcacactccaccgcacgcttggtacatcgcctttgcgcccgcacaagcgcccaaggtggctgttgccgtgctggtggagaacggggctgatcggctgtccgccaccggaggtgccctcgcggcaccgatcgggcgggcggtgatcgaagccgcactgcagggggaaccatga

SEQ ID NO: 7 - DNA, 1410 bp, Mycobacterium tuberculosis
atgacgacacgactgcaagcgccggtggccgtaacgcccccgttgccgactcggcgcaacgctgaactgctgctgctgtgctttgccgccgtaatcacgtttgccgcactgctggtcgtgcaggccaatcaagaccagggggtgccctgggacttgactagctacggactggccttcctgaccctgttcggatccgcgcatctggccatccggcgcttcgccccctacactgacccgctgttgctcccggtggtggcactgctcaacggacttggcctggtaatgatccaccgcctcgatctggtggacaacgagatcggcgagcatcggcaccccagcgcaaaccagcagatgctgtggacgctggtgggcgtagctgccttcgcgctcgtggtgaccttcctcaaggaccaccgacagctcgcacgctacggctacatttgcgggctcgcgggtctggttttcttggcagttcccgcgctgctcccggcagcactgtccgaacagaacggcgccaagatctggatccggttgcccggcttctcgattcaacccgccgaattttcaaagattctgctgctgatcttcttttcggcggtactggtggccaaacgcggcctgttcaccagcgccggcaaacatttgctcggaatgaccctgccgcgcccgcgagacctcgcgccactgttggcagcctgggtcatctcggtgggtgtgatggtcttcgagaaagacctcggcgcttcgctgctgctgtacacatcgtttctggtggtggtttacctcgccacccagcggttcagttgggtcgtcatcggcctgactctgttcgcggcaggaaccttggtggcgtacttcatttttgagcacgtccggctccgcgtacagacctggctggatccgttcgcagatccagacggcaccggatatcagatcgtgcagtcgcttttcagcttcgctacaggcggtatcttcggcaccgggctcggtaatggtcaacccgacaccgtgcccgcggcatccaccgatttcatcatcgccgcgttcggcgaagagcttgggttggtgggcttgacggccatcctgatgctctacaccatcgtgatcatccggggtttgcgcacggccatcgccacccgcgatagcttcggcaagctgctggccgccggcctctcatcgacgctagccattcagctgttcatcgtcgtcggcggtgtgacccgactcattccgctgaccgggttgaccacaccgtggatgtcctacggcgggtcttcactgctggccaactacatattgctggccatcctggcacgcatctcgcacggagcccgccgcccactgcgcacccgcccacgaaataagtcgccgattacggcggccggcaccgaggtcatcgaacgcgtatga

SEQ ID NO: 8 - DNA, 1545 bp, Mycobacterium tuberculosis
gtggcgcgcgtgaccctggtcctgcgatacgcggcgcgcagcgatcgcggcttggtacgcgccaacaacgaagactcggtctacgctggggcacggctattggccctggccgacggcatgggtgggcatgcggccggcgaggtggcgtcccagttggtgattgccgcattggcccatctcgatgacgacgagcccggtggcgatctgctggccaagctggatgccgcggtgcgcgccggcaactcggctatcgcagcgcaagtcgagatggagcccgatctcgaaggcatgggtaccacgctcaccgcaatcctgttcgcgggcaaccggctcggcctggtgcatatcggtgactcgcgcggttacctgctgcgcgacggtgagctgacgcagatcaccaaggacgacacgtttgtccaaacgctggtcgacgaaggccggatcaccccggaggaggcgcacagccacccgcaacgctcgttgatcatgcgggcgttgaccggccatgaggtcgaaccgacgctgaccatgcgagaagcccgcgccggtgatcgttacctgctgtgctcggacgggttgtccgatccggttagcgatgaaactatcctcgaggccctgcagatccccgaggttgccgagagcgctcaccgcctcattgaactggcgctgcgcggcggcggccccgacaacgtcactgtcgtcgtcgccgacgtcgtcgactacgactacggccagacccaaccgattctggccggggcggtctcaggcgacgacgaccaactgaccctgcccaacaccgccgccggccgggcctctgccatcagccagcgcaaggagatcgttaaacgcgttccgccacaggccgatacattcagtcggccacggtggtcgggccgacggctagcattcgttgtcgcactggtgaccgtgctgatgactgcgggcctgctcattggtcgcgcgatcatccgcagcaactactacgtagcggactacgccggcagcgtgtccatcatgcgggggattcaagggtcgctactgggcatgtccctgcaccagccttacctgatgggctgcctcagcccgcgtaacgagctgtcgcagatcagctacggacagtctgggggccctctcgactgccatctgatgaaactggaggatctgcgaccgccggagcgcgcacaggttcgggccggtctcccggccggcactctcgatgacgccatcgggcagttgcgcgaactggcggccaactccctgctgccgccttgcccggcgccgcgtgccacgtccccgcccgggcgcccggccccacccaccaccagcgagacaaccgaaccaaacgtcacctcctcgccagcctctccatcacccaccacctccgcgccggcccccaccggaactactcctgccatccccacgagtgcctccccggcagcgcccgcgtcgccgccgacgccttggcccgtcaccagctcgccgacgatggccgcacttccgccacccccgcctcagccgggcatcgactgccgggcggcggcatga

SEQ ID NO: 9 - DNA, 468 bp, Mycobacterium tuberculosis
atgcaggggttggtactgcaactgacgcgtgccggattcttgatgttgttgtgggtattcatctggtccgtgctacggatcttgaagaccgacatttatgcgccgaccggcgcggtcatgatgcgccgcggcctggcgctgcgagggacgctcttaggcgcgcgtcagcgccggcacgctgcacgctacctggtggtgaccgaaggtgcgttgactggcgcgcgtatcacgctgagcgaacagccggtgttgatcgggcgcgccgacgactcgaccctggtgctgaccgacgactacgcctcgacgcggcacgctcggctgtctatgcgcggctccgagtggtacgtcgaagatctaggatcgaccaacggcacttacctggacagggcgaaggtgacgactgcggtacgagttccgatcggaacgccggttcgcatcggcaaaactgcaatcgagttgcgcccgtga

SEQ ID NO: 10 - DNA, 1584 bp, Mycobacterium tuberculosis
atgggtagccagaaaaggctggttcagcgcgttgagcgcaaactcgagcagacggttggcgatgcgtttgcccgcatctttggaggctcgatcgtcccgcaagaggtcgaagccctgctgcgccgcgaggcggccgacggcatccagtcgctgcagggaaatcgccttttggcgcccaacgaatacatcattaccctcggtgtgcacgactttgagaagttgggcgctgatcctgagctgaagtcaaccggttttgctcgggacttggcggactatatccaagaacaggggtggcaaacgtatggtgatgtggtcgtccgattcgagcagtcgtcgaacctgcataccggccagttccgcgcccgcggcactgttaaccccgacgttgagacccacccgccggtcatcgattgcgcccggccacaatcaaaccacgcgtttggcgcagaaccaggagtagcaccaatgagtgacaattcgagctaccgtggcggtcaggggcaggggcgtcccgacgagtattacgacgaccgctatgcgcgtccgcaagaggatccgcgtggtggcccggatccgcaaggcggatctgacccccgcggggggtatccacccgagacgggcggctacccgccccagccgggctacccacgcccgcgccacccggaccagggcgactaccccgagcaaatcgggtaccccgaccagggcggttaccccgagcaacgcggttaccccgagcaacgcggctaccccgaccagcgcgggtaccaggaccagggtcgaggctaccccgaccaagggcaggggggctatccgccgccctacgagcaacgccctcctgtttctcccggcccggctgccggctacggcgctcccggctacgaccagggctatcgccaaagcggcggctacggcccttcacccggtggcggccagcccggctacggcgggtacggggagtacgggcgtggcccggctcgccacgaggagggcagctatgtgccctctggccctccgggcccgcccgagcaacgaccggcttaccccgaccaaggcggttacgaccagggctaccagcaaggcgccacgacatacggccggcaagactatggcggcggcgctgactacacccgctacaccgaatccccgcgggtcccgggatacgctcctcagggtggcgggtacgccgaacccgccggccgagactacgactacggccaatcaggcgctccggactacggtcagccagcgcccggtggctacagcggttacgggcagggcggctatgggtccgccggaacgtcggttacgctgcagctcgacgacggcagcggacgcacttaccagctccgcgagggctccaacatcatcggtcgcggacaggacgcccagttccggctgcccgacaccggtgtgtcacgccgtcacttggagatccggtgggacgggcaggtcgcattgctcgcagacctgaactccaccaacggcaccactgttaacaatgcaccggtacaggagtggcagttggccgacggtgatgtgatccgcttgggacactccgagatcatcgtccgcatgcactga

SEQ ID NO: 11 - DNA, 2316 bp, Mycobacterium tuberculosis
atgcccactggcttgggctatgactttctgcgccctgtcgaggactcggggatcaacgacctgaagcactattacttcatggcggatttggccgatgggcaaccgctaggccgggcaaacctctatagcgtctgtttcgacctggccaccaccgaccgcaagctcactccggcctggcgaacgaccatcaaacggtggtttccggggtttatgaccttccgtttcctcgagtgcgggttgctcaccatggtgagcaacccgctggcgttgcggtccgacaccgacttggagcgggtattgcctgtgctggccggccagatggaccagttggcgcatgacgacgggtcggatttcttgatgatccgggacgtggacccggaacactaccagcgataccttgacatcctgcgcccgttgggctttcggcctgcgctgggcttttcccgggtagacacgaccatcagctggtcgagcgtggaagaggcactgggctgcctgtctcacaaaaggcgcctgccgttgaagacgtcgctggagtttcgtgagcggttcggtatcgaggtcgaggaactcgacgagtatgccgagcatgcgccggtattggcccggctttggcgcaacgtcaagacggaggcaaaggattaccagcgcgaggacctgaaccctgagttcttcgcggcgtgttctcggcatctgcatggacgtagcagactgtggttgttccgctaccagggcacgccaattgccttctttttgaacgtttggggtgcggatgagaactacatactgcttgagtggggcatcgatcgtgattttgaacattataggaaggcgaatctgtaccgggcggcgctgatgctcagcctaaaagatgcgatcagccgagataaacggcgaatggaaatgggtattacgaactatttcacaaaacttcgcattccgggtgcccgagtcataccgaccatctatttcctgcgtcacagcacggatccggtgcatacggcaacgttagcgcgaatgatgatgcacaatattcaacggccaacgctacccgacgatatgtcggaggaattctgtcgctgggaagagcgaatacgtctggaccaggacgggctacccgaacacgatatctttcgcaagatcgatcgtcagcacaaatacacggggctcaaactcggcggagtctacggtttttatccccgattcaccggaccgcagcgatccacggtcaaggccgcggagctgggcgagatcgtgttgctgggcacgaactcgtatctgggcctggccacccatccagaggtggtggaggcctcggcggaggccacgcgacggtacggcaccggctgctcgggttcgccgttgctgaacggcacgttggacttgcacgtctcgcttgagcaggaactagcctgttttttgggcaaacccgccgccgtgttgtgctccaccggatatcagagcaacctggcggcgatcagcgcgctatgcgaatccggggacatgatcatccaagacgcgctgaaccaccgcagcctgttcgacgccgccaggttgtccggggccgacttcaccttgtaccggcacaacgacatggaccacctggcgcgggtgctacgccgcaccgaggggcgccgccggatcatcgtcgtggacgcggtgttcagcatggaaggcaccgtcgccgacctggccaccatcgccgagcttgccgaccggcacggctgccgggtctatgtggacgagtcccatgcgctgggcgtgctcggccccgacgggcgaggagcttcggccgcgttgggtgtcttggcgcgcatggacgtggtgatgggcacgttcagcaaatcctttgcctccgtcggcgggttcatcgccggagatcggcccgtcgtggactacatccggcacaacggttcaggtcatgtgttttccgccagcctgccgccggccgccgcggctgccacccacgcggctctgcgcgtcagtcggcgtgaacccgaccggcgggctcgggtgctggccgcggccgagtacatggccaccggcctggcacggcagggctatcaggccgagtatcacggaaccgcgatcgtgccggtgatcctgggcaacccgaccgtggcgcatgcgggctatctgcggctgatgcgctccggggtgtatgtgaacccggtggcccccccagccgtgccggaggagcgttcgggattccgcaccagctacctagccgaccaccgacaatctgacctcgaccgggccttgcacgtgtttgccggccttgccgaggacctgaccccgcaaggagccgcgctatga

SEQ ID NO: 12 - DNA, 2037 bp, Mycobacterium tuberculosis
gtggtgatcctgttgccgatggtcaccttcacgatggcctacctgatcgtcgacgttcccaagccaggtgacatccgtaccaaccaggtctccacgatccttgccagcgacggctcggaaatcgccaaaattgttccgcccgaaggtaatcgggtcgacgtcaacctcagccaggtgccgatgcatgtgcgccaggcggtgattgcggccgaagaccgcaatttctattcgaatccgggattctcgttcaccggcttcgcgcgggcagtcaagaacaacctgttcggcggcgatctgcagggcggatcgacgattacccagcagtacgtcaagaacgcgctggtcggttccgcacagcacgggtggagcggtctgatgcgcaaggcgaaagaattggtcatcgcgacgaagatgtcgggggagtggtctaaagacgatgtgctgcaggcgtatctgaacatcatctacttcggccggggcgcctacggcatttcggcggcgtccaaggcttatttcgacaagcccgtcgagcagctgaccgttgccgaaggggcgttgttggcagcgctgattcggcggccttcgacgctggacccggcggtcgaccccgaaggggcccatgcccgctggaattgggtactcgacggcatggtggaaaccaaggctctctcgccgaatgaccgtgcggcgcaggtgtttcccgagacagtgccgcccgatctggcccgggcagagaatcagaccaaaggacccaacgggctgatcgagcggcaggtgacaagggagttgctcgagctgttcaacatcgacgagcagaccctcaacacccaggggctggtggtcaccaccacgattgatccgcaggcccaacgggcggcggagaaggcggttgcgaaatacctggacgggcaggaccccgacatgcgtgccgccgtggtttccatcgacccgcacaacggggcggtgcgtgcgtactacggtggcgacaatgccaatggctttgacttcgctcaagcgggattgcagactggatcgtcgtttaaggtgtttgctctggtggccgcccttgagcaggggatcggcctgggctaccaggtagacagctctccgttgacggtcgacggcatcaagatcaccaacgtcgagggcgagggttgcgggacgtgcaacatcgccgaggcgctcaaaatgtcgctgaacacctcctactaccggctgatgctcaagctcaacggcggcccacaggctgtggccgatgccgcgcaccaagccggcattgcctccagcttcccgggcgttgcgcacacgctgtccgaagatggcaagggtggaccgcccaacaacgggatcgtgttgggccagtaccaaacccgggtgatcgacatggcatcggcgtatgccacgttggccgcgtccggtatctaccacccgccgcatttcgtacagaaggtggtcagtgccaacggccaggtcctcttcgacgccagcaccgcggacaacaccggcgatcagcgcatccccaaggcggtagccgacaacgtgactgcggcgatggagccgatcgcaggttattcgcgtggccacaacctagcgggtgggcgggattcggcggccaagaccggcactacgcaatttggtgacaccaccgcgaacaaagacgcctggatggtcgggtacacgccgtcgttgtctacggctgtgtgggtgggcaccgtcaagggtgacgagccactggtaaccgcttcgggtgcagcgatttacggctcgggcctgccgtcggacatctggaaggcaaccatggacggcgccttgaagggcacgtcgaacgagactttccccaaaccgaccgaggtcggtggttatgccggtgtgccgccgccgccgccgccgccggaggtaccaccttcggagaccgtcatccagcccacggtcgaaattgcgccggggattaccatcccgatcggtcccccgaccaccattaccctggcgccaccgcccccggccccgcccgctgcgactcccacgccgccgccgtga

SEQ ID NO: 13 - DNA, 1683 bp, Mycobacterium tuberculosis
gtgaccggcgcgctgtcccaaagcagcaacatctcgccacttcctttggccgccgatctgcggagcgccgataaccgcgattgccccagccgcaccgacgtattgggtgccgctctggcgaatgtcgtcggtggcccggtaggccggcacgcgctgatcggccgcacccggctgatgaccccgctgcgggtgatgtttgcaatcgcgttggtgttcctggcgctcggttggtcgacgaaagcggcctgcttgcagtccaccggaaccggtccaggtgatcagcgggtggccaactgggataaccagcgtgcttactaccagttgtgctactccgatacggtgccgctctatggcgctgagttattgagccaaggcaagtttccgtacaaatcaagctggatcgaaaccgacagcaacggcacaccgcagctgcgctacgacggacagatcgcggtgcgctatatggagtatccggtgctgactgggatctatcagtacctgtcgatggcgatagccaagacctacaccgcgttaagcaaggtggctcccctcccggtggttgccgaagtggtgatgttcttcaacgtcgccgcgttcggtttggcgctggcgtggctgacaaccgtctgggcgacctcgggcctggccggccgccggatatgggatgcggcgctggtggccgcctcaccgctggtgatctttcagatattcaccaatttcgatgcgctggcaacgggtttggcgacgagtgggctgctggcctgggcgcggcgcagaccggtgcttgccggtgtgctgatcgggttgggctccgcggcgaaactgtatccgctgttgttcttgtacccgttgttgctgctgggcatccgggccggtcgcctgaatgctctggcccgcaccatggcggccgcggcggcgacctggttgttggtgaatctgccggtgatgctgctctttccgcgcggctggtcggagttcttccggctcaacacccggcgcggcgacgacatggactcgttgtacaacgtcgtcaagtcgttcaccggctggcgtggcttcgaccccaccctgggcttctgggagccgccgctggtgctgaacacggttgtcacgctcttgttcgtgttatgttgtgcggcaattgcttacatcgcgctcaccgcaccccaccggccgcgcgtggcgcagctgactttcttgacggtggccagcttcctgttggtcaacaaggtgtggagtccccagttctcgctttggctggtgccgctggccgtgctggctttgccgcaccgccggatcttgctggcgtggatgacgatcgacgcgttggtgtgggtgccgcggatgtactacctatacggcaacccgagccgctcgctgcccgagcagtggttcaccacgacggtgttgctgcgtgacatcgccgtgatggtgctgtgcggactggtggtctggcagatctaccgccccgggcgcgacctcgtgcgtaccggcgggccaggggcactgccggcttgtgggggagtcgacgacccggtgggaggggtctttgccaacgccgccgacgccccgccaggtcggctaccgtcgtggctgcgtccccggctgggcgacgagcatgcgcgagagaggacgcccgatgcaggtcgcgatcgcactttttccgggcaacaccgcgcttga

SEQ ID NO: 14 - DNA, 1197 bp, Mycobacterium tuberculosis
atgcgtactccggtgatattggtggcaggtcaggatcacaccgacgaggtgacgggcgccttgttgcgccggaccggaacggtggtcgtggagcaccggtttgacggccatgtggtgcgacggatgactgccacgctgagccgtggcgaattgatcaccacggaggacgctttggagttcgcccacggctgtgtgtcgtgcacaatccgcgacgacctgctggtgctgttacgcagactgcaccgccgagacaatgtcggccggatcgtcgtgcacctggcgccgtggctggagccccagcccatctgctgggcgatcgaccacgtgcgggtttgcgtcggacacggatacccagacggaccagccgccctcgacgtgcgggtcgcggccgtggtgacctgtgtggactgcgtaaggtggctgccgcagtcactcggcgaggacgaactgcccgacgggcgcacggtggcccaagtgacggtcggtcaggccgagttcgccgaccttctggtgctgacccacccggaaccggtcgccgtggcggttctgcgccgactggcccctcgagcgcgaatcaccggcggcgtcgaccgcgtcgagctggcgctggcgcatctggacgacaactcacggaggggtcgtaccgataccccgcacacgccattgctggcgggcctgcctccgttggcagccgacggtgaggttgcgatcgtggaattcagtgcccgccgcccgtttcacccgcaacgtctgcatgccgcggttgacctgctgctcgatggcgtggttcgcactcgaggtcggctgtggctggccaaccggccggatcaggtcatgtggctcgaatcagccggtggcggtctgcgggtcgcatcggccggaaagtggttggcggcgatggcggcctcggaggtggcctatgtcgacctggagcggcggttgttcgccgacctgatgtgggtctacccgttcggagaccggcacaccgcgatgacggtactggtatgcggcgccgatccgaccgacatcgtcaatgccctgaacgcggcgctgctcagcgacgacgaaatggcatctccgcaacgctggcagtcctacgtcgaccctttcggcgactggcatgacgacccgtgccacgaaatgcccgatgcggctggggaattctcggcacaccgcaactcaggagaatctcgatga

SEQ ID NO: 15 - DNA, 1068 bp, Mycobacterium tuberculosis
atgagcaattcgcgccgccgctcactcaggtggtcatggttgctgagcgtgctggctgccgtcgggctgggcctggccacggcgccggcccaggcggccccgccggccttgtcgcaggaccggttcgccgacttccccgcgctgcccctcgacccgtccgcgatggtcgcccaagtggggccacaggtggtcaacatcaacaccaaactgggctacaacaacgccgtgggcgccgggaccggcatcgtcatcgatcccaacggtgtcgtgctgaccaacaaccacgtgatcgcgggcgccaccgacatcaatgcgttcagcgtcggctccggccaaacctacggcgtcgatgtggtcgggtatgaccgcacccaggatgtcgcggtgctgcagctgcgcggtgccggtggcctgccgtcggcggcgatcggtggcggcgtcgcggttggtgagcccgtcgtcgcgatgggcaacagcggtgggcagggcggaacgccccgtgcggtgcctggcagggtggtcgcgctcggccaaaccgtgcaggcgtcggattcgctgaccggtgccgaagagacattgaacgggttgatccagttcgatgccgcgatccagcccggtgattcgggcgggcccgtcgtcaacggcctaggacaggtggtcggtatgaacacggccgcgtccgataacttccagctgtcccagggtgggcagggattcgccattccgatcgggcaggcgatggcgatcgcgggccagatccgatcgggtggggggtcacccaccgttcatatcgggcctaccgccttcctcggcttgggtgttgtcgacaacaacggcaacggcgcacgagtccaacgcgtggtcgggagcgctccggcggcaagtctcggcatctccaccggcgacgtgatcaccgcggtcgacggcgctccgatcaactcggccaccgcgatggcggacgcgcttaacgggcatcatcccggtgacgtcatctcggtgacctggcaaaccaagtcgggcggcacgcgtacagggaacgtgacattggccgagggacccccggcctga

SEQ ID NO: 16 - DNA, 1878 bp, Mycobacterium tuberculosis
atggctcgtgcggtcgggatcgacctcgggaccaccaactccgtcgtctcggttctggaaggtggcgacccggtcgtcgtcgccaactccgagggctccaggaccaccccgtcaattgtcgcgttcgcccgcaacggtgaggtgctggtcggccagcccgccaagaaccaggcagtgaccaacgtcgatcgcaccgtgcgctcggtcaagcgacacatgggcagcgactggtccatagagattgacggcaagaaatacaccgcgccggagatcagcgcccgcattctgatgaagctgaagcgcgacgccgaggcctacctcggtgaggacattaccgacgcggttatcacgacgcccgcctacttcaatgacgcccagcgtcaggccaccaaggacgccggccagatcgccggcctcaacgtgctgcggatcgtcaacgagccgaccgcggccgcgctggcctacggcctcgacaagggcgagaaggagcagcgaatcctggtcttcgacttgggtggtggcactttcgacgtttccctgctggagatcggcgagggtgtggttgaggtccgtgccacttcgggtgacaaccacctcggcggcgacgactgggaccagcgggtcgtcgattggctggtggacaagttcaagggcaccagcggcatcgatctgaccaaggacaagatggcgatgcagcggctgcgggaagccgccgagaaggcaaagatcgagctgagttcgagtcagtccacctcgatcaacctgccctacatcaccgtcgacgccgacaagaacccgttgttcttagacgagcagctgacccgcgcggagttccaacggatcactcaggacctgctggaccgcactcgcaagccgttccagtcggtgatcgctgacaccggcatttcggtgtcggagatcgatcacgttgtgctcgtgggtggttcgacccggatgcccgcggtgaccgatctggtcaaggaactcaccggcggcaaggaacccaacaagggcgtcaaccccgatgaggttgtcgcggtgggagccgctctgcaggccggcgtcctcaagggcgaggtgaaagacgttctgctgcttgatgttaccccgctgagcctgggtatcgagaccaagggcggggtgatgaccaggctcatcgagcgcaacaccacgatccccaccaagcggtcggagactttcaccaccgccgacgacaaccaaccgtcggtgcagatccaggtctatcagggggagcgtgagatcgccgcgcacaacaagttgctcgggtccttcgagctgaccggcatcccgccggcgccgcgggggattccgcagatcgaggtcactttcgacatcgacgccaacggcattgtgcacgtcaccgccaaggacaagggcaccggcaaggagaacacgatccgaatccaggaaggctcgggcctgtccaaggaagacattgaccgcatgatcaaggacgccgaagcgcacgccgaggaggatcgcaagcgtcgcgaggaggccgatgttcgtaatcaagccgagacattggtctaccagacggagaagttcgtcaaagaacagcgtgaggccgagggtggttcgaaggtacctgaagacacgctgaacaaggttgatgccgcggtggcggaagcgaaggcggcacttggcggatcggatatttcggccatcaagtcggcgatggagaagctgggccaggagtcgcaggctctggggcaagcgatctacgaagcagctcaggctgcgtcacaggccactggcgctgcccaccccggcggcgagccgggcggtgcccaccccggctcggctgatgacgttgtggacgcggaggtggtcgacgacggccgggaggccaagtga

SEQ ID NO: 17 - DNA, 708 bp, Mycobacterium tuberculosis
gtgacggacggaaatcaaaagccggatggcaattcgggcgaacaggtaaccgtcactgacaagcggcggatcgatcccgagacgggtgaagtgcggcacgtccctcccggcgacatgccgggagggacggctgcggccgatgcggcgcacaccgaagacaaggtcgccgagctgaccgccgatctgcaacgcgtgcaggccgacttcgccaactaccgtaagcgggcgttgcgcgatcagcaggcggccgctgaccgagccaaggccagcgttgtcagccaattgctgggtgtactggacgatctcgagcgggcgcgcaagcacggcgatttggagtcgggtccactgaagtcggtcgccgacaagctagacagcgcgttgaccgggctgggtctggtggcgttcggtgccgagggcgaggatttcgaccccgtgctgcacgaagcggtgcaacacgagggcgacggcgggcaggggtccaagccggtaatcggcaccgtcatgcggcagggctaccaactgggtgagcaggtgctgcggcacgccttggtcggcgtcgtcgacacggtggtcgtcgacgcggccgaactggagtcagtcgacgacggcactgcggtcgcagataccgccgaaaacgatcaagctgaccagggcaatagcgccgacacctcgggcgaacaggcagaatcagaaccgtcgggcagttaa

SEQ ID NO: 18 - DNA, 1188 bp, Mycobacterium tuberculosis
atggcccaaagggaatgggtcgaaaaagacttctaccaggagctgggcgtctcctctgatgccagtcctgaagagatcaaacgtgcctatcggaagttggcgcgcgacctgcatccggacgcgaacccgggcaacccggccgccggcgaacggttcaaggcggtttcggaggcgcataacgtgctgtcggatccggccaagcgcaaggagtacgacgaaacccgccgcctgttcgccggcggcgggttcggcggccgtcggttcgacagcggctttgggggcgggttcggcggtttcggggtcggtggagacggcgccgagttcaacctcaacgacttgttcgacgccgccagccgaaccggcggtaccaccatcggtgacttgttcggtggcttgttcggacgcggtggcagcgcccgtcccagccgcccgcgacgcggcaacgacctggagaccgagaccgagttggatttcgtggaggccgccaagggcgtggcgatgccgctgcgattaaccagcccggcgccgtgcaccaactgccatggcagcggggcccggccaggcaccagcccaaaggtgtgtcccacttgcaacgggtcgggcgtgatcaaccgcaatcagggcgcgttcggcttctccgagccgtgcaccgactgccgaggtagcggctcgatcatcgagcacccctgcgaggagtgcaaaggcaccggcgtgaccacccgcacccgaaccatcaacgtgcggatcccgcccggtgtcgaggatgggcagcgcatccggctagccggtcagggcgaggccgggttgcgcggcgctccctcgggggatctctacgtgacggtgcatgtgcggcccgacaagatcttcggccgcgacggcgacgacctcaccgtcaccgttccggtcagcttcaccgaattggctttgggctcgacgctgtcggtgcctaccctggacggcacggtcggggtccgggtgcccaaaggcaccgctgacggccgcattctgcgtgtgcgcggacgcggtgtgcccaagcgcagtgggggtagcggcgacctacttgtcaccgtgaaggtggccgtgccgcccaatttggcaggcgccgctcaggaagctctggaagcctatgcggcggcggagcggtccagtggtttcaacccgcgggccggatgggcaggtaatcgctga

SEQ ID NO: 19 - DNA, 1035 bp, Mycobacterium tuberculosis
atgcctatcgcaacgcccgaggtctacgcggagatgctcggtcaggccaaacaaaactcgtacgctttcccggctatcaactgcacctcctcggaaaccgtcaacgccgcgatcaaaggtttcgccgacgccggcagtgacggaatcatccagttctcgaccggtggcgcagaattcggctccggcctcggggtcaaagacatggtgaccggtgcggtcgccttggcggagttcacccacgttatcgcggccaagtacccggtcaacgtggcgctgcacaccgaccactgccccaaggacaagttggacagctatgtccggcccttgctggcgatctcggcgcaacgcgtgagcaaaggtggcaatcctttgttccagtcgcacatgtgggacggctcggcagtgccaatcgatgagaacctggccatcgcccaggagctgctcaaggcggcggcggccgccaagatcattctggagatcgagatcggcgtcgtcggcggcgaagaggacggcgtggcgaacgagatcaacgagaagctgtacaccagcccggaggacttcgagaaaaccatcgaggcgctgggcgccggtgagcacggcaaatacctgctggccgcgacgttcggcaacgtgcatggcgtctacaagcccggcaacgtcaagcttcgccccgacatccttgcgcaagggcaacaggtggcggcggccaagctcggactgccggccgacgccaagccgttcgacttcgtgttccacggcggctcgggttcgcttaagtcggagatcgaggaggcgctgcgctacggcgtggtgaagatgaacgtcgacaccgacacccagtacgcgttcacccgcccgatcgccggtcacatgttcaccaactacgacggagtgctcaaggtcgatggcgaggtgggtgtcaagaaggtctacgacccgcgcagctacctcaagaaggccgaagcttcgatgagccagcgggtcgttcaggcgtgcaatgacctgcactgcgccggaaagtccctaacccactaa

SEQ ID NO: 20 - DNA, 4209 bp, Mycobacterium tuberculosis
atgacagacggttcggtcactgcggataagcttcaaaaatggtttcgagagtacttgtccacgcatatcgagtgtcatccaaatgaggtcagcctagacgttccgattagagatttaggtttgaaatcgattgatgtcttagcgattcccggcgacctcggtgacagatttgggttttgtattcccgatttggccgtttgggataatcctagcgctaatgatttgattgatagtctgttgaaccagcgtagtgctgactcgttaagagagagtcatggacacgccgacaggaacacgcagggtcggggcagcataaacgagccggttgcggtcatcggagtgggctgtcgatttccgggagatattgacggcccggaacggctatgggactttctgaccgagaagaagtgtgcgataacagcgtatccagatcgtgggttcacgaatgctggaactttcgcggagtccggaggctttttaaaggatgtcgcgggtttcgataatagattttttgatatcccgccggacgaggctctgcgaatggatccgcaacaacggttgttactggaggtctcttgggaagcgttagagcatgcaggaattattcctgagtcattaagactttcacgtacgggcgtattcgttggggtgtcgtcaactgactacgtccggcttgtgtcagctagcgctcagcaaaagtctactatttgggataacaccggcggttcttcgagtattattgccaatagaatctcatactttctcgatattcagggtccgtccattgtcattgacacggcatgctcgtcatccctggtcgccgtgcatctagcctgtcgaagtctcagtacctgggactgcgatatcgcacttgtcggtgggacgaatgttcttatttcaccagaaccatggggtgggtttagggaagcgggcatcttgtcgcagacaggctgctgtcacgcgttcgataaatccgccgacgggatggtacgcggtgagggatgcggagttatcgtgctgcagcgcctcagtgatgcacgccttgagggccggcggatattagcgattctgacgggttcagcggtcaatcaggacggtaagtccaacggtattatggcgccaaatcctagtgcgcaaattggtgttcttgaaaatgcatgcaagagcgctcgcgtcgatccgctggaaatcggctacgtcgaggcccacgggaccggaacgtcgttaggggataggatcgaggcgcacgccttaggcatggtctttggtcgcaagagaccgggatctgggcccctgatgatcgggagcatcaagccgaatatcggccatctggaaggtgcggctggcatcgccggattgatcaaggcggtgttgatggttgagcgtggctcgctgcttccgagcggggggtttacggagccaaatccagctatcccattcacggaattgggcctgagagttgtagacgaacttcaggagtggccggtggtggcgggtcggccgcgccgggctggggtgtcatcgttcggctttggcggcaccaatgcgcatgtgattgtcgaggaagctggttcggttggggcggacacggtttcgggccgcgcggatgttggcggttccggtggtggggtggtggcgtgggtgatttcggggaagacggcttcggcgttggctgctcaggcgggtcggttggggcggtatgtgcgggctcggccggcgcttgatgttgttgatgtggggtattcgttggtgagcacgcggtcggtgtttgatcatcgggcggtggtggtcggccagactcgcgatgagttgctggctgggttggctggggtggttgctggtcggccggaggctggggtggtctgcggtgttggcaagccggcgggcaagacggcttttgtgtttgccggtcagggctcgcagtggctgggtatgggtagcgagctttatgctgcctacccggttttcgccgaggccctcgatgctgtggtggacgagttggaccggcacctgcggtatccgctgcgcgatgtgatctgggggcacgaccaagatctgttgaataccaccgaattcgcccagccggcgctgtttgcggtggaggtggcgctgtatcggctgctcatgtcgtggggggtgcggccgggtttggtgctgggtcattcggtgggcgagttggccgcggcgcacgtcgccggggcgctgtgtttgccggatgcggcgatgctggtggccgcgcgtggacggttgatgcaggcgttgcccgccggcggcgccatgtttgcggtgcaggcccgtgaagacgaggtagcgccgatgctggggcacgatgtgagcatcgcggcggtcaatggtccggcttcggtggtgatctctggtgcccacgatgcggtgagcgcgatcgctgatcggctgcgcggccagggccgtcgggtccaccggttggcggtctcgcatgcctttcactcggcgttgatggagccgatgatcgctgagttcacagccgttgcggccgaactgtctgtgggcttgcccacgatcccggtcatttccaatgtgaccgggcagttggtggccgacgacttcgcctcagctgattactgggcccggcatatccgggcggtggtgcggtttggcgacagtgttcgtagtgcccactgcgccggtgccagtcgtttcatcgaagtcgggcccggtggcggcttgacgtcgttgatcgaggcatcgctggccgacgcgcagatcgtgtcggtgcccacgctgcgcaaagatcggcccgaaccggtcagtgtgatgacggcggcggcccagggcttcgtctcggggatgggcctggattgggcctcggtgttttccgggtaccggcccaagcgggtggagttgccgacgtatgccttccagcatcaaaagttctggctcgcaccagccccatcggtcagcgaccccaccgccgccggccagatcggggctagcgatggtggtgctgaactcttggcgtcctccgggtttgccgcccggctggccggtcggtcggccgacgagcaactcgccgcagcgatcgaggtggtatgtgagcatgccgcagcggtgctggggcgcgacggcgctgccggactcgacgctggccaggcgtttgccgattcgggatttaattccttgagtgccgtggagctacgtaaccgcttaacagccgtcaccgcagtaacgctgccggccaccgcgatcttcgatcaccccaccccgaccgaactagcccagtatctgatcacccaaatagacggtcacggcagctccgccgccgcagcggcaaacccggcggagcgaatcgatgcgctcaccgatctttttctacaagcttgcgatgcgggtcgggatgccgatggttggaagatggtcgccctggcgtcgaatacgcgcgagcgcatgagctcaccggttcggaacaacgtatcgaagaacgtcgcactgctggcagatggtatctccgatgtggttgtaatttgtatcccaactctaactgtgctatcggatcagcgtgaatatcgagatattgcgaatgcgatgacaggccgccattcggtttattcgcttacgcttcccgggttcgattcgtctgatgcactgccgcaaaacgcggatatgattgttgaaaccgtatctaacgcaattattgatgtggtaggcggcagctgccgttttgtgctgtcgggctattcatcgggtggggtgttggcctatgccctctgctcccatctgtcggtcaagcaccagcggaatcccctcggagtcgcactcatcgatacatatctgcctagtcagatcgccaatccttcaatgaatgaagggttcagccccaacgatactgggaagggcctttcccgtgaagtaattcgagtggccagaatgttgaatcggttaactgccacccgactcaccgcggcagccacctatgctgcaatctttcaggcctgggaaccaggtagatcaatggctccggttcttaacatcgtggcgaaggaccgaatagctaccgtcgaaaatttacgcgaagaacgaatcaaccggtggcgaactgctgctgcagaggcggcctattctgtagccgaagtacccggggatcatttcggaatgatgagcacctcgagtgaggcaatagctaccgaaatacatgattggatttctgggctcgttcgagggcctcatcggtag

SEQ ID NO: 21 - DNA, 2187 bp, Mycobacterium tuberculosis
gtgacccacccggacccggcccgccaactcacccttaccgcccggctgaacacctcggccgtcgactcacgccgcggcgtcgttcggttgcaccccaatgccattgctgcccttggcatccgcgagtgggacgcggtgtcgctgaccggctctcggacaaccgccgcggtcgccggcctggccgcggcagacaccgcggtcgggacggtgctgctcgatgacgtcacactgtccaatgcgggccttcgcgaaggcaccgaggtgatcgtcagcccggtcaccgtctacggagcgcgatcggtgacgctgagcggttcaacgctggccacccagtcggtgccgccggtcacgctgcggcaggccctactcggcaaggtgatgaccgtcggtgacgcggtctcgctgctgccccgcgatctaggccccggcacatccacgtcggctgccagccgcgcattggcagctgcggtcgggatcagttggacctcggagctgctgaccgttaccggcgtcgaccccgacgggccggtcagcgtgcagcccaactcgctggtcacctggggcgctggggtcccggccgcaatgggtacgtccacggccgggcaagtgagcatctcgagtccggagatccagatcgaagagctcaagggcgcccagccgcaggctgccaagctcaccgaatggctcaagcttgccctcgatgagccgcacctactacagaccttgggcgccggcaccaatttgggtgtgctggtgtcgggtccggccggggtgggcaaggcgacgctggtgcgcgcggtgtgcgacggccgaaggttggtgacactggatggtccggagattggagctctggccgccggagaccgggtcaaagccgtggcctcggcagtgcaggcggttcgccatgagggcggtgtgttgctgatcaccgatgccgacgccctgctgccagccgccgccgagccggtagcctcgctgatcctgtccgagctgcgtaccgcggtggccaccgccggtgtggtattgatcgccacctcagcacggcccgatcaactcgatgcccggctgcgttcccccgagttgtgcgaccgggagcttggcctgccgctgcccgacgcggccacccgcaaatcgctgctggaggcgctgctgaatccggttcctaccggagacctcaacctcgacgaaatcgcctcccgcacaccgggtttcgtcgtggccgacctggctgcgctggttcgcgaggcggcgctgcgggcagcgtctcgagccagtgccgacggccgaccaccgatgctgcaccaagacgacctcctcggtgcgttgaccgtcatccggccgctgtcccgctcggccagcgacgaagtcaccgtgggtgacgtgacgctcgacgatgtcggtgacatggccgcggccaaacaagcactgaccgaggcggtgctgtggccgctgcagcaccccgacaccttcgctcggctaggtgtcgaaccgccgcgcggggtgttgctgtacggcccgcccggctgcggcaagacctttgtggttcgtgccctggccagcaccggacagttgagcgtgcatgccgtcaaagggtcggagctgatggacaagtgggtgggctcctcggagaaggcagtccgcgagctattccggcgggcccgcgactccgcgccgtcactggtgttcctcgacgagctggacgctctggcgccacggcgcggtcagagcttcgactcgggcgtctccgaccgggtggtggccgcgctgctgactgagctcgacggtattgacccgctgcgggatgtcgtcatgctaggcgcgaccaaccggcccgatctgatagacccggcgctgctgcgcccggggcggctagaacggctggtgttcgttgaaccgcccgacgctgccgctcgccgcgaaatcctgcgcaccgctggcaagtcgatcccgctgagctccgacgtcgacctggacgaggtggcagccggactcgacggttatagtgccgccgactgtgtggcgctgctgcgcgaagccgcgcttaccgcgatgcggcgttccatcgatgccgccaacgtcaccgccgccgacctggcgaccgcgcgagaaaccgtgcgcgcgtcgctggatccgctgcaggtggcgtcgctgcgtaagttcggcaccaagggtgaccttcggtcctag

SEQ ID NO: 22 - DNA, 861 bp, Mycobacterium tuberculosis
atgatcggaaagccccgcggcaggcgaggggtaaacctgcagatactgcccagcgcgatgacggtgctgtccatttgcgcgggactgaccgcaatcaagtttgcgctcgagcaccagccgaaggccgcgatggcactgatcgccgcagcggccatcctcgacgggctcgacggccgggtggcccgcatcctggatgcccagtcgcggatgggcgcagagatcgactcactggccgacgcggtgaacttcggagtgacacccgcgctggtgctttacgtgtcgatgttgtcgaagtggccggtcggttgggtggtcgtgctgctctacgcggtgtgcgtggtattacggctggcgcggtacaacgcactgcaggacgacggaacccagcccgcctacgcgcatgaattcttcgtcggaatgcccgcgccggcgggcgcggtttccatgatcggcctgctagccctcaaaatgcagttcggcgaaggatggtggacctcgggctggttcctcagcttttgggtgacgggaacgtcgatactcttggtcagcgggatcccgatgaaaaagatgcacgccgtgtcggtaccacccaactacgcggccgccctgctggcggtgctggctatctgcgcggcggccgcagtcctggccccctacttgttgatctgggtgatcatcatcgcctacatgtgccatattcctttcgcggtgcgcagccagcgctggcttgcccaacaccctgaggtgtgggacgacaagcccaagcaacggcgcgcggtgcggcgcgcgagccgccgggcgcatccctaccggccgtcgatggcgcggctgggcctgcgcaagccgggtcgacggctgtga

SEQ ID NO: 23 - DNA, 1623 bp, Mycobacterium tuberculosis
atggccaagacaattgcgtacgacgaagaggcccgtcgcggcctcgagcggggcttgaacgccctcgccgatgcggtaaaggtgacattgggccccaagggccgcaacgtcgtcctggaaaagaagtggggtgcccccacgatcaccaacgatggtgtgtccatcgccaaggagatcgagctggaggatccgtacgagaagatcggcgccgagctggtcaaagaggtagccaagaagaccgatgacgtcgccggtgacggcaccacgacggccaccgtgctggcccaggcgttggttcgcgagggcctgcgcaacgtcgcggccggcgccaacccgctcggtctcaaacgcggcatcgaaaaggccgtggagaaggtcaccgagaccctgctcaagggcgccaaggaggtcgagaccaaggagcagattgcggccaccgcagcgatttcggcgggtgaccagtccatcggtgacctgatcgccgaggcgatggacaaggtgggcaacgagggcgtcatcaccgtcgaggagtccaacacctttgggctgcagctcgagctcaccgagggtatgcggttcgacaagggctacatctcggggtacttcgtgaccgacccggagcgtcaggaggcggtcctggaggacccctacatcctgctggtcagctccaaggtgtccactgtcaaggatctgctgccgctgctcgagaaggtcatcggagccggtaagccgctgctgatcatcgccgaggacgtcgagggcgaggcgctgtccaccctggtcgtcaacaagatccgcggcaccttcaagtcggtggcggtcaaggctcccggcttcggcgaccgccgcaaggcgatgctgcaggatatggccattctcaccggtggtcaggtgatcagcgaagaggtcggcctgacgctggagaacgccgacctgtcgctgctaggcaaggcccgcaaggtcgtggtcaccaaggacgagaccaccatcgtcgagggcgccggtgacaccgacgccatcgccggacgagtggcccagatccgccaggagatcgagaacagcgactccgactacgaccgtgagaagctgcaggagcggctggccaagctggccggtggtgtcgcggtgatcaaggccggtgccgccaccgaggtcgaactcaaggagcgcaagcaccgcatcgaggatgcggttcgcaatgccaaggccgccgtcgaggagggcatcgtcgccggtgggggtgtgacgctgttgcaagcggccccgaccctggacgagctgaagctcgaaggcgacgaggcgaccggcgccaacatcgtgaaggtggcgctggaggccccgctgaagcagatcgccttcaactccgggctggagccgggcgtggtggccgagaaggtgcgcaacctgccggctggccacggactgaacgctcagaccggtgtctacgaggatctgctcgctgccggcgttgctgacccggtcaaggtgacccgttcggcgctgcagaatgcggcgtccatcgcggggctgttcctgaccaccgaggccgtcgttgccgacaagccggaaaaggagaaggcttccgttcccggtggcggcgacatgggtggcatggatttctga

SEQ ID NO: 24 - DNA, 1110 bp, Mycobacterium tuberculosis
atgaaacggagcggtgtcggttcgctctttgccggtgcgcatattgccgaggcggtcccgttggcgccgctgaccactttgcgtgtgggcccgatcgcccgacgtgtcatcacttgcaccagcgccgaacaggtggtggctgcgctgcggcacctggattcggcggccaagaccggagctgaccgcccgctggtgtttgctggtggctccaatttggtgatcgccgagaacctgaccgacctgaccgtggtgcggttggccaatagcggcatcaccatcgacggtaacttggtgcgggccgaggccggtgcggtcttcgatgacgtggtggttagggccatcgaacagggtctgggcggactggaatgcctgtctggcatcccaggatcggccggggcgacacccgtgcagaacgtgggggcgtatggcgcggaggtgtctgacaccatcactcgggttcggcttttggatcggtgcacgggtgaggtgcgttgggtatccgcgcgcgacctgcgcttcggctatcgcacgagcgtgctcaaacacgctgatgggcttgcggtgcccaccgtggtcttggaggtggagtttgcgctggatccgtcgggccgcagcgcaccgctgcgctacggcgagctgatcgccgcgctgaatgcgaccagcggcgagcgcgccgacccgcaagcggtccgcgaagcggtgctggccctgcgggcacgcaagggcatggtgctggacccgaccgaccatgacacctggagcgtgggatcgttcttcacaaacccggtggtcacccaggatgtttacgaacggctggccggtgacgcggccaccagaaaggacggtccggtcccgcactatcccgcgcccgacggcgtcaagctggccgccggctggctggtggaacgggccggcttcggcaagggctatccggatgccggcgccgccccatgccggctttccaccaaacatgcgctggcgctgacaaatcgtggcggggccaccgccgaagatgtggtgacgctggcgcgcgccgtgcgcgatggggtccatgatgtgtttggtatcacactaaaacccgaacccgtgctgatcggctgcatgttgtag

SEQ ID NO: 25 - DNA, 1356 bp, Mycobacterium tuberculosis
gtggtcattcgtgtgctgtttcgcccggtatctttgatacccgtgaataactccagcaccccccagagtcaggggccgatcagtcggcgtctggcgttgacggcccttgggtttggggtgttggcaccgaacgttctggtcgcgtgcgccggcaaagtgaccaagctggccgagaagaggccgccaccggcgcctcgtctgactttccggcctgccgactctgccgccgacgtggtgccgatcgcgccgatcagcgtcgaggtcggtgacggctggtttcagcgggtcgcgctgaccaattcggcaggcaaggtcgtcgccggggcatacagccgggatcgcaccatctacacgatcaccgagccgctgggctacgacacgacctacacctggagcggttcggccgtcggccatgacggcaaggcggttccggtggcgggcaagttcaccaccgtggcacccgtcaagacgatcaacgcgggattccagctcgccgacggccagaccgtcgggatcgcggcgccggtgattattcagttcgattcaccgatcagcgacaaggccgccgtcgagcgggcactaaccgtgaccaccgacccgcctgtcgagggcggctgggcctggctgcccgacgaggcgcagggcgctcgcgtgcactggcgtcctcgggagtactacccggcgggtaccaccgtcgacgtcgacgccaagctgtatgggctgccgttcggcgacggcgcgtacggcgcgcaggatatgtcgttgcacttccagatcggtcgtcgtcaggtggtcaaggccgaagtctcgtcgcaccgcatccaagtcgtcaccgatgccggcgtcatcatggacttcccgtgcagctacggcgaggccgacttggcgcgcaacgtcacccgcaacggcatccacgtcgtcaccgagaaatactcggacttctacatgtccaacccggccgccggttacagccatatccacgaacgttgggcggtgcggatttccaacaacggcgagttcatccatgccaaccctatgagcgccggtgcccagggcaacagcaatgtcaccaacggctgtatcaacctgtcgacggagaacgccgaacagtactaccgcagcgcggtctacggtgacccggttgaggtgaccggcagttcgatccagctgtcctacgccgacggtgacatctgggactgggcggtggactgggacacctgggtgtcgatgtcggcgctaccgccaccggcggccaaaccggcggcgacgcaaatcccggtcaccgccccggtcacgccgtcggatgcccccaccccgtccggcacacccacgactactaacggaccgggtgggtag

SEQ ID NO: 26 - DNA, 750 bp, Mycobacterium tuberculosis
atggcaaacactggcagcctggtgttgctgcgccacggcgagagcgactggaatgccctcaacctgttcaccggctgggtcgatgtcggcctgacggacaagggccaggcagaggcggttcgaagcggcgagctgatcgcggaacacgacctattgcccgacgtgctctacacctcgttgctgcggcgcgcgatcaccaccgcgcatctggcgttggacagcgccgatcggctctggattcccgtgcggcgtagctggcggctcaacgaacgccactacggcgcgctgcagggtttggacaaggccgagaccaaggcccgctatggcgaagagcagttcatggcctggcggcgcagctatgacacgccgccgccgccgatcgagcggggcagtcagttcagccaggacgccgaccctcgttacgccgacatcggcggtggcccgctcaccgaatgtctggctgacgtggtcgcccggtttttgccatatttcaccgacgtcatcgttggcgacttgcgggtcggcaagacggtgctgatcgttgcccacggcaactcgttgcgcgcgctggtcaagcacctggaccagatgtctgacgacgaaatcgtcggactgaacatcccgaccggaattccgctgcgctacgacctggattccgcgatgaggccgctggtgcgcggtggtacgtatctggacccggaggcggcagccgccggcgccgccgcggtggccggccagggccgcgggtaa

SEQ ID NO: 27 - DNA, 1233 bp, Mycobacterium tuberculosis
gtgactgtgttctcggcgctgttgctggccggggttttgtccgcgctggcactggccgtcggtggtgctgttggaatgcggctgacgtcgcgggtcgtcgaacagcgccaacgggtggccacggagtggtcgggaatcacggtttcgcagatgttgcaatgcattgtcacgctgatgccgctgggcgccgcggtggtggacacccatcgcgacgttgtctacctcaacgaacgggccaaagagctaggtctggtgcgcgaccgccagctcgatgatcaggcctggcgggccgcccggcaggcgctgggtggtgaagacgtcgagttcgacctgtcgccgcgcaagcggtcggccacgggtcgatccgggctatcagtgcatgggcatgcccggttgctgagcgaggaagaccgccggttcgccgtggtgttcgtgcacgaccagtcggattatgcgcggatggaggcggctaggcgtgacttcgtggccaacgtcagtcacgagctcaagacgcccgtcggtgccatggctctactcgccgaggcgctgctggcgtcggccgacgactccgaaaccgttcggcggttcgccgagaaggtgctcattgaggccaaccggctcggtgacatggtcgccgagttgatcgagctatcccggctacagggcgccgagcggctacccaatatgaccgacgtcgacgtcgatacgattgtgtcggaagcgatttcacgccataaggtggcggccgacaacgccgacatcgaagtccgcaccgacgcgcccagcaatctgcgggtgctgggcgaccaaactctgctggttaccgcactggcaaacctggtttccaatgcgattgcctattcgccgcgcgggtcgctggtgtcgatcagccgtcgccgtcgcggtgccaacatcgagatcgccgtcaccgaccggggcatcggcatcgcgccggaagaccaggagcgggtcttcgaacggttcttccggggggacaaggcgcgctcgcgtgccaccggaggcagcggactcgggttggccatcgtcaaacacgtcgcggctaatcacgacggcaccatccgcgtgtggagcaaaccgggaaccgggtcaacgttcaccttggctcttccggcgttgatcgaggcctatcacgacgacgagcgacccgagcaggcgcgagagcccgaactgcggtcaaacaggtcacaacgagaggaagagctgagccgatga

SEQ ID NO: 28 - DNA, 888 bp, Mycobacterium tuberculosis
atgcttttcggcatggcaaggatcgcgattatcggcggcggcagcatcggtgaggcattgctgtcgggtctgctgcgggcgggccggcaggtcaaagacctggtagtggccgagcggatgcccgatcgcgccaactacctggcgcagacctattcggtgttggtgacgtcggcggccgacgcggtggagaacgcgacgttcgtcgtcgtcgcggtcaaaccagccgacgtcgagccggtgatcgcggatctggcgaacgcgactgcggcggccgaaaacgacagtgctgagcaggtgttcgtcaccgtggtagcgggcatcacgatcgcgtatttcgaatccaagctaccggctgggacgccagtggtgcgtgcgatgccgaacgcggcggcattggtgggagcgggggttacagcgctggccaaaggccgctttgtcaccccgcaacagcttgaggaggtctcggccttgttcgacgcggtcggcggcgtgctgaccgttccggaatcgcagttggacgcggtgaccgcggtgtccggctcgggtccggcctatttctttctgctggtcgaggccctggtggatgccggagtcggggtgggcttgagccgtcaggtggccaccgatctcgccgcgcagacaatggctggctcagcggcgatgctgctggagcggatggagcaagaccagggtggcgccaatggcgagctgatggggctgcgcgtggaccttaccgcatcacggctgcgcgccgcggttacctcgccgggcggtacgaccgccgctgcgctgcgggaactcgaacgcggcgggtttcggatggctgtcgacgcggcggttcaagccgccaaaagccgctctgagcagctcagaattacaccggaatga

SEQ ID NO: 29 - DNA, 1590 bp, Mycobacterium tuberculosis
atgtggcggtcgttgacgtcgatgggcaccgcgctggtgctgctgtttttgctcgcgctggctgccatacccggggccctgctgccgcagcgtggcctcaacgccgccaaggtggacgactacctggccgcgcacccactcatcggtccgtggctggacgagctgcaggccttcgacgtgttctccagcttctggttcaccgccatctacgtgctgctgttcgtgtccctcgtcggctgtctggccccgcggacgatcgagcacgcccgcagcctgcgggctacaccggtcgccgccccgcgcaacctggcccggctgcccaagcacgcccacgcccggctggccggcgagcccgccgccctggccgccaccatcacgggccggctgcgcggctggcgcagcatcacccggcaacaaggcgacagcgtggaagtctccgccgagaagggctacctgcgcgagttcggcaacctggtgttccacttcgcgctgctgggtctgctggtggcggtggccgtcggcaagctgttcggctacgagggcaacgtgatcgtgatagccgacggcggacccggtttttgttcggcgtcgccggccgcgttcgactcgtttcgcgccggcaacaccgtcgacggcacgtcgttgcacccgatctgtgtgcgggtcaacaacttccaagcgcactacctgccgtccgggcaggccacctcgttcgccgccgacatcgactatcaggccgacccggccactgctgacctgatcgccaacagctggcggccctaccggctgcaggtcaatcacccgctgcgggtcggcggcgaccgggtgtacctgcagggccacggctatgcgcccaccttcaccgtgacgttcccggacgggcagacccgcacgtcgaccgtgcagtggcgacccgacaacccgcagaccctgctgtcggcgggcgtcgtgcgcatcgacccgccggccggcagctaccccaaccccgacgagcgtcgcaaacaccagatcgccatccagggcctgctggctcccaccgagcagctcgacggcaccctgctgtcgtcgcgtttccccgcgctcaatgccccggcggtggccatcgacatctaccgcggcgacaccggcctggacagcgggcggccccagtcgttgttcaccctggaccaccggctgatcgagcagggccggctggtcaaggaaaagcgggtcaacctgcgcgccggtcagcaagtccgcatcgaccaaggcccggcggccggcacggtggtccggttcgacggcgcggtgccgttcgtcaacctgcaggtctcccacgaccccggccagtcctgggtgctggtcttcgcaatcacgatgatggcgggactgctggtgtcgctgctggtgcgcaggcgccgggtgtgggcgcggatcacgccgacgaccgcgggtacggtaaacgtcgagctgggcggcctgacgcgcaccgacaactccgggtggggcgccgagttcgagcggctgaccgggcggttgctggcgggttttgaggcgcggtccccggacatggccgaagcggccgcagggaccggaagggacgtcgattga

SEQ ID NO: 30 - DNA, 3519 bp, Mycobacterium tuberculosis
ttggcagattcccgccagagcaaaacagccgctagtcctagtccgagtcgcccgcaaagttcctcgaataactccgtacccggagcgccaaaccgggtctccttcgctaagctgcgcgaaccacttgaggttccgggactccttgacgtccagaccgattcgttcgagtggctgatcggttcgccgcgctggcgcgaatccgccgccgagcggggtgatgtcaacccagtgggtggcctggaagaggtgctctacgagctgtctccgatcgaggacttctccgggtcgatgtcgttgtcgttctctgaccctcgtttcgacgatgtcaaggcacccgtcgacgagtgcaaagacaaggacatgacgtacgcggctccactgttcgtcaccgccgagttcatcaacaacaacaccggtgagatcaagagtcagacggtgttcatgggtgacttcccgatgatgaccgagaagggcacgttcatcatcaacgggaccgagcgtgtggtggtcagccagctggtgcggtcgcccggggtgtacttcgacgagaccattgacaagtccaccgacaagacgctgcacagcgtcaaggtgatcccgagccgcggcgcgtggctcgagtttgacgtcgacaagcgcgacaccgtcggcgtgcgcatcgaccgcaaacgccggcaaccggtcaccgtgctgctcaaggcgctgggctggaccagcgagcagattgtcgagcggttcgggttctccgagatcatgcgatcgacgctggagaaggacaacaccgtcggcaccgacgaggcgctgttggacatctaccgcaagctgcgtccgggcgagcccccgaccaaagagtcagcgcagacgctgttggaaaacttgttcttcaaggagaagcgctacgacctggcccgcgtcggtcgctataaggtcaacaagaagctcgggctgcatgtcggcgagcccatcacgtcgtcgacgctgaccgaagaagacgtcgtggccaccatcgaatatctggtccgcttgcacgagggtcagaccacgatgaccgttccgggcggcgtcgaggtgccggtggaaaccgacgacatcgaccacttcggcaaccgccgcctgcgtacggtcggcgagctgatccaaaaccagatccgggtcggcatgtcgcggatggagcgggtggtccgggagcggatgaccacccaggacgtggaggcgatcacaccgcagacgttgatcaacatccggccggtggtcgccgcgatcaaggagttcttcggcaccagccagctgagccaattcatggaccagaacaacccgctgtcggggttgacccacaagcgccgactgtcggcgctggggcccggcggtctgtcacgtgagcgtgccgggctggaggtccgcgacgtgcacccgtcgcactacggccggatgtgcccgatcgaaacccctgaggggcccaacatcggtctgatcggctcgctgtcggtgtacgcgcgggtcaacccgttcgggttcatcgaaacgccgtaccgcaaggtggtcgacggcgtggttagcgacgagatcgtgtacctgaccgccgacgaggaggaccgccacgtggtggcacaggccaattcgccgatcgatgcggacggtcgcttcgtcgagccgcgcgtgctggtccgccgcaaggcgggcgaggtggagtacgtgccctcgtctgaggtggactacatggacgtctcgccccgccagatggtgtcggtggccaccgcgatgattcccttcctggagcacgacgacgccaaccgtgccctcatgggggcaaacatgcagcgccaggcggtgccgctggtccgtagcgaggccccgctggtgggcaccgggatggagctgcgcgcggcgatcgacgccggcgacgtcgtcgtcgccgaagaaagcggcgtcatcgaggaggtgtcggccgactacatcactgtgatgcacgacaacggcacccggcgtacctaccggatgcgcaagtttgcccggtccaaccacggcacttgcgccaaccagtgccccatcgtggacgcgggcgaccgagtcgaggccggtcaggtgatcgccgacggtccctgtactgacgacggcgagatggcgctgggcaagaacctgctggtggccatcatgccgtgggagggccacaactacgaggacgcgatcatcctgtccaaccgcctggtcgaagaggacgtgctcacctcgatccacatcgaggagcatgagatcgatgctcgcgacaccaagctgggtgcggaggagatcacccgcgacatcccgaacatctccgacgaggtgctcgccgacctggatgagcggggcatcgtgcgcatcggtgccgaggttcgcgacggggacatcctggtcggcaaggtcaccccgaagggtgagaccgagctgacgccggaggagcggctgctgcgtgccatcttcggtgagaaggcccgcgaggtgcgcgacacttcgctgaaggtgccgcacggcgaatccggcaaggtgatcggcattcgggtgttttcccgcgaggacgaggacgagttgccggccggtgtcaacgagctggtgcgtgtgtatgtggctcagaaacgcaagatctccgacggtgacaagctggccggccggcacggcaacaagggcgtgatcggcaagatcctgccggttgaggacatgccgttccttgccgacggcaccccggtggacattattttgaacacccacggcgtgccgcgacggatgaacatcggccagattttggagacccacctgggttggtgtgcccacagcggctggaaggtcgacgccgccaagggggttccggactgggccgccaggctgcccgacgaactgctcgaggcgcagccgaacgccattgtgtcgacgccggtgttcgacggcgcccaggaggccgagctgcagggcctgttgtcgtgcacgctgcccaaccgcgacggtgacgtgctggtcgacgccgacggcaaggccatgctcttcgacgggcgcagcggcgagccgttcccgtacccggtcacggttggctacatgtacatcatgaagctgcaccacctggtggacgacaagatccacgcccgctccaccgggccgtactcgatgatcacccagcagccgctgggcggtaaggcgcagttcggtggccagcggttcggggagatggagtgctgggccatgcaggcctacggtgctgcctacaccctgcaggagctgttgaccatcaagtccgatgacaccgtcggccgcgtcaaggtgtacgaggcgatcgtcaagggtgagaacatcccggagccgggcatccccgagtcgttcaaggtgctgctcaaagaactgcagtcgctgtgcctcaacgtcgaggtgctatcgagtgacggtgcggcgatcgaactgcgcgaaggtgaggacgaggacctggagcgggccgcggccaacctgggaatcaatctgtcccgcaacgaatccgcaagtgtcgaggatcttgcgtaa

SEQ ID NO: 31 - DNA, 3951 bp, Mycobacterium tuberculosis
gtgctcgacgtcaacttcttcgatgaactccgcatcggtcttgctaccgcggaggacatcaggcaatggtcctatggcgaggtcaaaaagccggagacgatcaactaccgcacgcttaagccggagaaggacggcctgttctgcgagaagatcttcgggccgactcgcgactgggaatgctactgcggcaagtacaagcgggtgcgcttcaagggcatcatctgcgagcgctgcggcgtcgaggtgacccgcgccaaggtgcgtcgtgagcggatgggccacatcgagcttgccgcgcccgtcacccacatctggtacttcaagggtgtgccctcgcggctggggtatctgctggacctggccccgaaggacctggagaagatcatctacttcgctgcctacgtgatcacctcggtcgacgaggagatgcgccacaatgagctctccacgctcgaggccgaaatggcggtggagcgcaaggccgtcgaagaccagcgcgacggcgaactagaggcccgggcgcaaaagctggaggccgacctggccgagctggaggccgagggcgccaaggccgatgcgcggcgcaaggttcgcgacggcggcgagcgcgagatgcgccagatccgtgaccgcgcgcagcgtgagctggaccggttggaggacatctggagcactttcaccaagctggcgcccaagcagctgatcgtcgacgaaaacctctaccgcgaactcgtcgaccgctacggcgagtacttcaccggtgccatgggcgcggagtcgatccagaagctgatcgagaacttcgacatcgacgccgaagccgagtcgctgcgggatgtcatccgaaacggcaaggggcagaagaagcttcgcgccctcaagcggctgaaggtggttgcggcgttccaacagtcgggcaactcgccgatgggcatggtgctcgacgccgtcccggtgatcccgccggagctgcgcccgatggtgcagctcgacggcggccggttcgccacgtccgacttgaacgacctgtaccgcagggtgatcaaccgcaacaaccggctgaaaaggctgatcgatctgggtgcgccggaaatcatcgtcaacaacgagaagcggatgctgcaggaatccgtggacgcgctgttcgacaatggccgccgcggccggcccgtcaccgggccgggcaaccgtccgctcaagtcgctttccgatctgctcaagggcaagcagggccggttccggcagaacctgctcggcaagcgtgtcgactactcgggccggtcggtcatcgtggtcggcccgcagctcaagctgcaccagtgcggtctgcccaagctgatggcgctggagctgttcaagccgttcgtgatgaagcggctggtggacctcaaccatgcgcagaacatcaagagcgccaagcgcatggtggagcgccagcgcccccaagtgtgggatgtgctcgaagaggtcatcgccgagcacccggtgttgctgaaccgcgcacccaccctgcaccggttgggtatccaggccttcgagccaatgctggtggaaggcaaggccattcagctgcacccgttggtgtgtgaggcgttcaatgccgacttcgacggtgaccagatggccgtgcacctgcctttgagcgccgaagcgcaggccgaggctcgcattttgatgttgtcctccaacaacatcctgtcgccggcatctgggcgtccgttggccatgccgcggctggacatggtgaccgggctgtactacctgaccaccgaggtccccggggacaccggcgaataccagccggccagcggggatcacccggagactggtgtctactcttcgccggccgaagcgatcatggcggccgaccgcggtgtcttgagcgtgcgggccaagatcaaggtgcggctgacccagctgcggccgccggtcgagatcgaggccgagctattcggccacagcggctggcagccgggcgatgcgtggatggccgagaccacgctgggccgggtgatgttcaacgagctgctgccgctgggttatccgttcgtcaacaagcagatgcacaagaaggtgcaggccgccatcatcaacgacctggccgagcgttacccgatgatcgtggtcgcccagaccgtcgacaagctcaaggacgccggcttctactgggccacccgcagcggcgtgacggtgtcgatggccgacgtgctggtgccgccgcgcaagaaggagatcctcgaccactacgaggagcgcgcggacaaggtcgaaaagcagttccagcgtggcgctttgaaccacgacgagcgcaacgaggcgctggtggagatttggaaggaagccaccgacgaggtcggtcaggcgttgcgggagcactaccccgacgacaacccgatcatcaccatcgtcgactccggcgccaccggcaacttcacccagactcgaacgctggccggtatgaagggcctggtgaccaacccgaagggtgagttcatcccgcgtccggtcaagtcctccttccgtgagggcctgaccgtgctggagtacttcatcaacacccacggcgctcgaaagggcttggcggacaccgcgttgcgcaccgccgactccggctacctgacccgacgtctggtggacgtgtcccaggacgtgatcgtgcgcgagcacgactgccagaccgagcgcggcatcgtcgtcgagctggccgagcgtgcacccgacggcacgctgatccgcgacccgtacatcgaaacctcggcctacgcgcggaccctgggcaccgacgcggtcgacgaggccggcaacgtcatcgtcgagcgtggtcaagacctgggcgatccggagattgacgctctgttggctgctggtattacccaggtcaaggtgcgttcggtgctgacgtgtgccaccagcaccggcgtgtgcgcgacctgctacgggcgttccatggccaccggcaagctggtcgacatcggtgaagccgtcggcatcgtggccgcccagtccatcggcgaacccggcacccagctgaccatgcgcaccttccaccagggtggcgtcggtgaggacatcaccggtggtctgccccgggtgcaggagctgttcgaggcccgggtaccgcgtggcaaggcgccgatcgccgacgtcaccggccgggttcggctcgaggacggcgagcggttctacaagatcaccatcgttcctgacgacggcggtgaggaagtggtctacgacaagatctccaagcggcagcggctgcgggtgttcaagcacgaagacggttccgaacgggtgctctccgatggcgaccacgtcgaggtgggccagcagctgatggaaggctcggccgacccgcatgaggtgctgcgggtgcagggcccccgcgaggtgcagatacacctggttcgcgaggtccaggaggtctaccgcgcccaaggtgtgtcgatccacgacaagcacatcgaggtgatcgttcgccagatgctgcgccgggtgaccatcatcgactcgggctcgacggagtttttgcctggctcgctgatcgaccgcgcggagttcgaggcagagaaccgccgagtggtggccgagggcggtgagcccgcggccggccgtccggtgctgatgggcatcacgaaggcgtcgctggccaccgactcgtggctgtcggcggcgtcgttccaggagaccactcgcgtgctgaccgatgcggcgatcaactgccgcagcgataagctcaacggtctgaaggaaaacgtgatcatcggcaagctgatcccggccggtaccggtatcaaccgctaccgcaacatcgcggtgcagcccaccgaggaggcccgcgctgcggcgtacaccatcccgtcgtatgaggatcagtactacagcccggacttcggtgcggccaccggtgctgccgtcccgctggacgactacggctacagcgactaccgctag

SEQ ID NO: 32 - DNA, 2364 bp, Mycobacterium tuberculosis
atggcacccgaggccaccgaggcgttcaacggcaccatcgagctggatattcgtgattcggagccggattggggcccatacgcagcgccggtggcaccggagcactcaccaaacatcctgtatctggtctgggacgacgtcggcatcgcgacctgggactgctttggcggcctggtcgagatgcccgcgatgacgcgcgtcgccgagcgtggcgtgcgactgtcgcaatttcacaccaccgcactgtgctcgccgacccgggcgtcgctgctgaccggtcgcaacgccaccaccgtaggcatggctaccatcgaagagttcaccgacgggttccccaactgcaacgggcggatcccggctgacaccgcgttgctcccagaggtgctggccgaacatggctacaacacctactgtgtgggcaagtggcacctgacgccactcgaagaatccaatatggcgtcgacgaagcggcactggccgacctcgcgtgggttcgagcggttctacggattcctaggcggggagaccgaccagtggtatcccgacctggtatacgacaaccacccagtgagtcctcccggcacacccgagggtggctaccacctgtcaaaagacatcgccgacaagacgatcgagttcattcgtgatgccaaggtgatcgcgcccgacaagccgtggttcagctacgtgtgcccaggcgccgggcatgcgccgcaccacgtcttcaaggaatgggcggacagatacgccggccgattcgacatggggtatgagcgctatcgcgagatcgtgctggaaaggcaaaaggcgctagggatcgtgccacccgacaccgaactgtcgcccataaacccttatctggatgtgccggggccaaacggcgagacctggccgctgcaggacacggtgcggccgtgggactcgctgagcgatgaagaaaagaagctgttttgccggatggccgaggtgttcgccggctttctgagctacaccgacgcccagatcggacggatcctggactacctcgaggaatccggccagctggacaacaccatcatcgtggtgatctccgacaacggcgccagcggcgagggcggacccaacggatcggtcaacgaaggcaagttcttcaacggctacatcgacaccgtcgctgaaagcatgaagctcttcgaccacctcggtggcccgcagacctacaaccactaccccatcgggtgggcaatggccttcaacaccccctacaagctgttcaagcgctacgcctcgcatgaaggcggcattgccgacccggcaatcatctcctggcccaacggcattgccgcacacggtgaaatccgcgacaactacgtcaatgtcagcgacatcacgcccaccgtctacgacctgttgggcatgacaccgccggggaccgtcaaggggattccgcagaaaccgatggacggcgtgagcttcatagcggcccttgccgacccggccgccgacaccggcaagaccacccagttctacaccatgctgggcacccgcgggatctggcatgaaggttggttcgccaacaccattcacgcggccacgcccgccggctggtcgaatttcaacgctgaccgctgggaactgttccacatcgcagcagaccgcagccagtgccacgacctggccgccgagcatcccgacaaacttgaggagctcaaggcgctgtggttctccgaagccgccaagtacaacgggctgccgctggccgatctgaacctcctggaaacgatgactcggtcgcggccttacctggtcagcgaacgagccagctacgtctactatcccgactgcgctgacgtcggcatcggcgcggccgtagagattcgcgggcgctcgttcgccgtgctggccgatgtgaccatcgataccaccggcgccgagggcgtgctgttcaagcacggcggcgcccatggcgggcacgtgctgttcgtccgggacggacgcttgcactacgtctacaacttcctcggtgagcgccagcagctggtcagctcgtcgggtccggtcccgtcgggaagacatctactcggggttcgttatttgcggaccggaaccgtgcccaacagtcacacgccggtgggcgatcttgagctgttcttcgacgagaacctggtcggcgccctgaccaatgtgctgacccaccctggaacgttcgggttggccggcgccgctatcagcgttggccgcaacggcggttcggctgtgtccagccactacgaagcgccgttcgcgttcaccggcggtaccatcacccaggtcaccgtcgacgtgtcaggccgaccgttcgaagatgtggaatccgatcttgcgcttgctttttcgcgtgactga

SEQ ID NO: 33 - DNA, 1356 bp, Mycobacterium tuberculosis
atgagcgctgttgcactaccccgggtttcgggtggccacgacgaacacggccacctcgaggagttccgcaccgatccgatcgggctgatgcaacgggtccgcgacgaatgcggagacgtcggtaccttccagctggccgggaagcaggtcgtgctgctgtccggctcgcacgccaacgaattcttcttccgggcgggcgacgacgacctggaccaggccaaggcatacccgttcatgacgccgatcttcggcgagggcgtggtgttcgacgccagcccggaacggcgtaaagagatgctgcacaatgccgcgctacgcggcgagcagatgaagggccacgctgccaccatcgaagatcaagtccgacggatgatcgccgactggggtgaggccggcgagatcgatctgctggacttcttcgccgagctgaccatctacacctcctcggcctgcctgatcggcaagaagttccgcgaccagctcgacgggcgattcgccaagctctatcacgagttggagcgcggcaccgacccactagcctacgtcgacccgtatctgccgatcgagagcttccgtcgccgcgacgaagcccgcaatggtctggtggcactggttgcggacatcatgaacggccggatcgccaacccacccaccgacaagagcgaccgtgacatgctcgacgtgctcatcgccgtcaaggctgagaccggcactccccggttctcggccgacgagatcaccggcatgttcatctcgatgatgttcgccggccatcacaccagctcgggtacggcttcgtggacgctgatcgagttgatgcgccatcgcgacgcctacgcggccgtgatcgacgaactcgacgagctgtacggcgacggccgatcggtgagtttccatgcgctgcgccagattccgcagctggaaaacgtgctgaaagagacgctgcgcctgcaccctccgctgatcatcctcatgcgagtggccaagggcgagttcgaggtgcaaggccaccggattcatgagggcgatctggtggcggcctccccggcgatctccaaccggatccccgaagacttccccgatccccacgacttcgtgccagcacgatacgagcagccgcgccaggaagatctgctcaaccgctggacgtggattccgttcggcgccggccggcatcgttgcgtgggggcggcgttcgccatcatgcagatcaaagcgatcttctcggtgttgttgcgcgagtatgagtttgagatggcgcaaccgccagaaagctatcgtaacgaccattcgaagatggtggtgcagttggcccagcccgcttgcgtgcgctaccgccggcgaacgggagtttaa

SEQ ID NO: 34 - DNA, 1629 bp, Mycobacterium tuberculosis
gtgcagtccgataagacggtgctgttggaagtcgaccatgaactggccggcgctgcacgcgccgccatcgcgccgttcgccgagctggaacgtgcacccgaacatgtccacacctaccgcatcacaccgctggcactgtggaatgctcgcgccgccggccatgatgccgagcaagtcgtcgacgcgctggtcagttactcccgctacgcggtgccgcaacccttgctcgtcgacatcgtcgacaccatggcccgctacggacgactgcagttggtcaagaacccggcccatggcctgacgctggtgagcctggaccgcgcggtgcttgaggaagtgctgcgcaacaagaagatcgcgccgatgcttggcgcccgcatcgatgacgacaccgtcgtcgtccaccccagcgaacgcggccgggtcaagcagctgctgctcaagatcggttggcccgcagaggatctcgccggctacgtcgatggtgaagcgcacccgatcagcctgcaccaggagggctggcagctgcgcgattaccagcggctggccgcggactcgttctgggcgggcggctccggggtggtggtgctgccatgtggggccggcaagacgctggtcggtgcggccgcaatggccaaagccggcgcgacgacgttgatcctggtcaccaatatcgtcgcggcccggcaatggaaacgagagctggtcgcgcgcacctcgctcaccgagaatgagatcggcgaattctcgggagaacgcaaggaaatccgacctgtcaccatctcgacataccagatgatcacccgccgcactaagggcgagtaccgccatctggaactgttcgacagccgcgactgggggctcatcatctatgacgaggtgcacctgttgccggcaccggtcttccggatgaccgctgacctgcagtccaaacggcggctggggctgaccgccacgttgatccgtgaagacggacgcgagggcgacgtgttttcccttatcggaccaaagcgctatgacgcgccgtggaaggacattgaggcgcagggctggatcgcgccagctgagtgcgtggaagtccgggtcacgatgaccgacagcgagcggatgatgtacgccaccgccgaacccgaagaacgctaccggatctgctcgacggtgcacaccaaaattgctgtggtcaagtcgattctggcgaagcacccggatgagcagaccctggtcatcggagcgtacttggatcagctcgacgagctgggcgccgagctcggcgctccggtgattcaggggtcgacaaggaccagcgaacgcgaggcactgttcgacgccttccgccgcggcgaggtcgctacgctcgtggtgtccaaggtggctaacttctccatcgacttgccggaagccgccgtggcggtacaggtttcgggaacattcggctcacgccaggaagaggcgcaacggctcggccggatattgcgacccaaggccgacgggggcggtgccatcttctactcggtggtggcccgcgacagcctggatgccgagtacgccgcacaccggcagcggtttttagctgagcagggctacggttacatcatccgcgacgccgacgacctgctgggcccggcaatttag

SEQ ID NO: 35 - DNA, 1488 bp, Mycobacterium tuberculosis
gtgagtcgtatcacgaccgaccaactgcggcacgcggtgctagaccggggatctttcgtcagctgggatagcgagccgctggcggtgccggtagccgactcctatgcgcgggagctggccgccgctcgggcggccaccggcgcggacgaatcggtgcagaccggtgagggacgcgtattcgggcggcgggtggccgtggtggcctgtgagttcgacttcctgggcggctcgattggggtggcagcggccgaacggatcaccgccgccgtcgagcgggcgaccgccgagcggctgccgctactggcgtcaccaagctcgggaggcacccgcatgcaagaaggcacggtcgcgtttctgcagatggtgaagatcgctgcggccatccagctgcacaaccaggcgcgcctgccctacctggtctatttgcgccatccgaccacgggtggagttttcgcgtcgtggggctcgctggggcatctcaccgtcgccgagccgggcgccctgatcggctttctgggaccacgggtctatgagttgctctatggcgaccccttcccatccggcgtccaaaccgccgagaatctacggcggcatgggatcatcgacggcgtcgttgcactggaccggctacgaccgatgctggatcgtgcgttgacggtgctcatcgacgctcccgaaccgcttccggcaccgcagacgcccgcgcccgtacccgatgtgcccacgtgggactcggtggtggcatcgcgccggccggaccggccgggcgtcaggcagctactgcgacacggcgccaccgaccgggtgttgttgtcaggaaccgatcaaggcgaagcggcgaccacgctgctggcgctggcccgctttggcggccaacccacggtggtcctcggccagcaaagggcagtaggcggcgggggaagcactgtcgggcccgctgcgttacgcgaagcccgacgcgggatggcgctcgccgccgagctgtgcctgccgctggtgctggtcattgacgcggccggacccgcgttgtcggccgcagccgaacagggcgggctggccggccagatcgcgcattgcctggccgagctcgtcacgctggataccccgaccgtgtcgatcctgctgggccagggcagcggcgggccggcgctggcgatgttgcccgccgaccgggtgctggccgcactccacggctggctggcgcccttgcctcccgaaggagccagcgcgatcgtgttccgagacactgctcatgccgccgaactcgctgccgcccaaggcatccggtcggccgacctactgaagtcggggattgtcgacaccatcgtgccggagtaccccgacgccgcagacgagccgatcgagttcgccctacgactgtcgaacgccatcgccgccgaagtgcacgcgttacggaagataccggccccggaacgcctcgcgactcggttgcaacgctaccgccggatcgggttgccccgcgactaa

SEQ ID NO: 36 - DNA, 1395 bp, Mycobacterium tuberculosis
atggccaagttggcccgagtagtgggcctagtacaggaagagcaacctagcgacatgacgaatcacccacggtattcgccaccgccgcagcagccgggaaccccaggttatgctcaggggcagcagcaaacgtacagccagcagttcgactggcgttacccaccgtccccgcccccgcagccaacccagtaccgtcaaccctacgaggcgttgggtggtacccggccgggtctgatacctggcgtgattccgaccatgacgccccctcctgggatggttcgccaacgccctcgtgcaggcatgttggccatcggcgcggtgacgatagcggtggtgtccgccggcatcggcggcgcggccgcatccctggtcgggttcaaccgggcacccgccggccccagcggcggcccagtggctgccagcgcggcgccaagcatccccgcagcaaacatgccgccggggtcggtcgaacaggtggcggccaaggtggtgcccagtgtcgtcatgttggaaaccgatctgggccgccagtcggaggagggctccggcatcattctgtctgccgaggggctgatcttgaccaacaaccacgtgatcgcggcggccgccaagcctcccctgggcagtccgccgccgaaaacgacggtaaccttctctgacgggcggaccgcacccttcacggtggtgggggctgaccccaccagtgatatcgccgtcgtccgtgttcagggcgtctccgggctcaccccgatctccctgggttcctcctcggacctgagggtcggtcagccggtgctggcgatcgggtcgccgctcggtttggagggcaccgtgaccacggggatcgtcagcgctctcaaccgtccagtgtcgacgaccggcgaggccggcaaccagaacaccgtgctggacgccattcagaccgacgccgcgatcaaccccggtaactccgggggcgcgctggtgaacatgaacgctcaactcgtcggagtcaactcggccattgccacgctgggcgcggactcagccgatgcgcagagcggctcgatcggtctcggttttgcgattccagtcgaccaggccaagcgcatcgccgacgagttgatcagcaccggcaaggcgtcacatgcctccctgggtgtgcaggtgaccaatgacaaagacaccctgggcgccaagatcgtcgaagtagtggccggtggtgctgccgcgaacgctggagtgccgaagggcgtcgttgtcaccaaggtcgacgaccgcccgatcaacagcgcggacgcgttggttgccgccgtgcggtccaaagcgccgggcgccacggtggcgctaacctttcaggatccctcgggcggtagccgcacagtgcaagtcaccctcggcaaggcggagcagtga

SEQ ID NO: 37 - DNA, 795 bp, Mycobacterium tuberculosis
ttggtcgacgcccacacccatctcgacgcgtgcggtgcacgagacgccgatacggtgcggtcgctcgtcgagcgagccgccgcggccggcgtgaccgcggtggtcaccgtcgccgacgacctggagtccgcgcgctgggtcacccgcgcggccgaatgggatcggcgagtctatgccgcggtggcgttgcacccgacccgcgccgatgcgctcaccgacgctgcccgtgccgagctcgagcgattggttgcccaccccagggtggtggccgtcggtgagaccggaatcgacatgtactggccgggtcgcctggacgggtgtgcggagccgcacgtccagcgggaggcctttgcctggcatatcgatctggccaagcggaccggtaaaccgctgatgatccacaatcgtcaggccgaccgcgacgtgctggacgtgctgcgggccgagggcgcgccggacaccgtgatcttgcactgcttctcgtcggacgcggcgatggcccgcacgtgtgtggacgccgggtggctgctcagcctgtccgggacggtgagcttccgtaccgcccgtgaactacgggaagccgtcccgctgatgccggtggagcagcttttggtggaaaccgatgcaccgtatttgaccccgcatccccaccggggcttggcgaacgaaccgtactgcctgccctataccgtgcgggcgctggctgaactggtcaatcggcgccccgaagaggtggcgctcatcaccacaagcaacgctcgccgagcttatgggctagggtggatgcgccaatga

SEQ ID NO: 38 - DNA, 1089 bp, Mycobacterium tuberculosis
atgttgcgcctggtagtcggtgcgctgctgctggtgttggcgttcgccggtggctatgcggtcgccgcatgcaaaacggtgacgttgaccgtcgacggaaccgcgatgcgggtgaccacgatgaaatcgcgggtgatcgacatcgtcgaagagaacgggttctcagtcgacgaccgcgacgacctgtatcccgcggccggcgtgcaggtccatgacgccgacaccatcgtgctgcggcgtagccgtccgctgcagatctcgctggatggtcacgacgctaagcaggtgtggacgaccgcgtcgacggtggacgaggcgctggcccaactcgcgatgaccgacacggcgccggccgcggcttctcgcgccagccgcgtcccgctgtccgggatggcgctaccggtcgtcagcgccaagacggtgcagctcaacgacggcgggttggtgcgcacggtgcacttgccggcccccaatgtcgcggggctgctgagtgcggccggcgtgccgctgttgcaaagcgaccacgtggtgcccgccgcgacggccccgatcgtcgaaggcatgcagatccaggtgacccgcaatcggatcaagaaggtcaccgagcggctgccgctgccgccgaacgcgcgtcgtgtcgaggacccggagatgaacatgagccgggaggtcgtcgaagacccgggggttccggggacccaggatgtgacgttcgcggtagctgaggtcaacggcgtcgagaccggccgtttgcccgtcgccaacgtcgtggtgaccccggcccacgaagccgtggtgcgggtgggcaccaagcccggtaccgaggtgcccccggtgatcgacggaagcatctgggacgcgatcgccggctgtgaggccggtggcaactgggcgatcaacaccggcaacgggtattacggtggtgtgcagtttgaccagggcacctgggaggccaacggcgggctgcggtatgcaccccgcgctgacctcgccacccgcgaagagcagatcgccgttgccgaggtgacccgactgcgtcaaggttggggcgcctggccggtatgtgctgcacgagcgggtgcgcgctga

SEQ ID NO: 39 - DNA, 954 bp, Mycobacterium tuberculosis
atgtgctgcacgagcgggtgcgcgctgaccatccggctgctcgggcgcactgagatcaggcggctggccaaagagctcgactttcggccgcgcaaatctctcggacagaacttcgtgcacgacgccaacacggtgcgacgggtggttgccgcctccggggtcagccgttccgacctggttttggaggtcgggccgggcctgggatcgctgaccctggcactgctcgaccgcggcgcgaccgtcaccgcggtcgagatcgatccactactggcttctcggctgcaacagaccgtggcggagcactcgcacagcgaggttcaccgactaacggtggtcaatcgcgacgtcctggccctgcgccgggaggatctagccgcggcgccgaccgcggtggttgccaatctgccgtacaacgtagcggtaccggcgttgttgcatctgcttgtcgagttcccgtcgatccgtgtcgtgacggtgatggtgcaggccgaggtcgccgaacggctcgccgccgagccgggcagcaaagagtacggcgtgcccagcgttaagctgcgcttcttcgggcgggttcgccgctgcggcatggtgtcgccgaccgttttctggcccattccgcgtgtctattccgggctggtacgcatcgatcgatatgagacctcgccctggcccaccgacgacgcttttcgacggcgggtattcgaactcgtggacatcgcattcgcgcagcggcgcaagacttctcgcaacgcgtttgtgcagtgggcgggctcgggaagcgagtcggcgaatcgattgttggcggccagcatcgaccccgcccgtcgcggtgagacgctgtccatcgacgacttcgtgcggctgctgcgacggtccggcggctccgacgaggccaccagcaccggccgggacgccagggcgccggacatttcggggcacgcgtcggcgagctga

SEQ ID NO: 40 - DNA, 921 bp, Mycobacterium tuberculosis
gtgcccaccgggtcggtcaccgttcgggtgcccggaaaggtcaacctctatctggcggtcggcgatcgccgcgaggacggctatcacgagctgaccacggtatttcatgccgtctcgctggtcgacgaggtaaccgttcgtaacgctgatgtgctctcgctcgagttggtcggcgagggggccgaccagctgccgaccgacgaacgcaatctcgcctggcaggcggccgagctgatggccgaacacgtgggccgggcgccggacgtctcgatcatgatcgacaaatccattccggtcgccggcggcatggccggtggcagcgcggacgctgcggcggtcctggttgcgatgaactcgttgtgggaactcaatgtgccccgccgcgacctgcgcatgctcgccgcgcggctaggcagcgatgtgccgtttgccctgcatggtggtaccgcgctggggacgggtcgcggcgaggagttggccaccgtgttatcccgcaacaccttccactgggtcctggcgttcgccgacagcgggttgctcacctccgcggtgtacaacgagctcgaccggctcagggaggtgggggatccgccccggcttggtgagcccgggccggttctggctgccttagctgcgggtgatccggatcagctggcgccgttgctgggtaatgaaatgcaagcggccgcggtgagcctggacccggcgctggctcgtgcgttacgcgccggtgtggaggccggcgcgctcgcaggcatcgtgtccggttcgggtcccacgtgtgccttcctgtgcacctcggcgagctcggcgatcgatgtcggcgcgcagctgtcgggggcgggagtttgtcgcaccgttcgagtcgccaccgggccggtacccggcgcccgcgtggtgtctgcgccgaccgaagtgtga

SEQ ID NO: 41 - DNA, 1113 bp, Mycobacterium tuberculosis
atgcttcgccgcatgggtgatgcatcgctgacaaccgagctcggccgcgttctggtcaccggcggcgcgggcttcgtgggcgccaacctggtgaccaccttgctggaccgcgggcactgggtgcgttccttcgaccgcgcgccgtcgctgttgcctgcgcatccgcaactggaggtgctgcaaggggacatcaccgacgcggacgtctgcgccgcggccgtggacggcatcgacacgatcttccacaccgcagcgatcatcgagctgatgggcggcgcgtcggtcaccgacgagtaccgccaacgtagctttgcggtcaacgtcggcggcaccgagaacctgctgcacgccggccagcgggccggggtgcagcggttcgtctacacgtcatccaacagtgtggtgatgggcggccagaacatcgccggcggtgacgagacgctgccctataccgaccggttcaacgacctctacaccgagaccaaggtggttgccgagcgattcgtgttggcccagaacggtgtcgacggcatgctgacgtgcgcgatccggcccagcggcatctggggaaacggcgatcagacgatgttccgcaagctgttcgaaagtgtgctcaagggccacgtcaaggtgctggtcgggcgcaagtcggcccggctggataactcttacgtgcacaacctgattcacggtttcatcttggccgctgcccatctggtgccggacggcacagcgcccgggcaggcttacttcatcaacgacgcagagccgatcaatatgttcgagttcgctcggccggtgctcgaggcgtgcgggcagcgctggccgaagatgcggatttccggccccgcggtccgctgggtaatgacggggtggcagcggctgcacttccggttcggattccccgcgccgctgctcgagccgctggccgtcgaacgactgtacctggacaactacttttcgatcgctaaggcacgccgcgacctgggctatgagccgctgttcaccacccagcaggcgctgaccgaatgcctgccgtactacgtgagtctgtttgagcagatgaagaacgaggcccgggcggaaaaaacggccgccacagtcaagccgtag

SEQ ID NO: 42 - DNA, 1008 bp, Mycobacterium tuberculosis
atggttccgacggtcgacatggggattcccggggcttcggtatcgtcgcgatcggtggccgaccgtcccaaccgtaagcgggtgctgctggccgagccgcgtggctactgcgctggcgtggatcgggccgtcgaaacggtcgaacgcgcgcttcaaaaacacggcccgcctgtctacgtgcgtcacgagatcgtgcataaccgccacgtggttgacaccctggctaaggccggtgcggttttcgtcgaagagaccgagcaggttcccgagggagcgattgtggtgttctccgcgcacggggtcgcgcctacggtgcacgtcagcgccagcgagcgcaacctgcaggtcattgacgccacctgcccgctggtcaccaaggtgcacaacgaggccaggcggttcgcccgggacgactacgacatcttgctgatcggtcatgagggccacgaggaagtcgtcggtactgctggggaagctcccgatcatgtgcagctggtcgacggggtggacgccgtcgaccaggtgaccgtccgtgacgaggacaaagtggtttggctgtcgcagaccaccctgtccgtcgatgagaccatggagattgtcgggcggttgcgtcggcgtttccccaagctgcaggatccgcccagcgacgacatctgctatgcgacccagaatcggcaggtcgcggtcaaggcgatggcgcccgagtgcgagctggtcatcgtggtcggctcgcgcaattcgtcgaattcggttcggctggtcgaggtggcgctgggtgccggggcgcgggccgcccacctggtggactgggccgacgatatcgactcggcctggctggacggcgttaccacggtcggcgttacgtcgggggcatcggtccccgaggtgctggtgcgcggtgtgctggagcggctggccgaatgcggctacgacatcgtgcaaccggtgacaacggccaacgagacgttggtgttcgcattgccccgggagctccgctcacctcgctga

SEQ ID NO: 43 - DNA, 675 bp, Mycobacterium tuberculosis
atgcacattgggctgaagatattcatatggggcgtgttaggactcgtcgttttcggcgcgctcctattcgggccagccggcacgttcgactattggcaggcgtgggtgttcctcgccgcatttgtgagcaccacgattggccccacaatctatctggctcgcaacgatcccgcggcccttcaacgtcgcatgcgcagcggtccgctcgcggagggccgaacgattcagaagttcatcgtcatcggcgcttttctggggttcttcgcgatgatggtgctgagcgcgtgcgaccatcgttatggttggtcgtcagtgccagccgcggtgtgcgtgatcggcgacgtcctagtgatgacgggccttggcatcgccatgctggtggtcatccagaacaggtatgccgcctcgacggtcagggtggaggcgggccagatattggcctccgacggtctctacaaaattgtccgacacccgatgtacgccgggaacgtggtcatgatgacaggcataccgctggcactgggctcttactgggcgatgttcatcctcgtccccggcacactggtgttggtgttccgcatcctcgacgaggaaaaactactgacgcaagaactcagcgggtaccgcgaataccggcaactggtgcgctaccggttggtgccctacgtgtggtag

SEQ ID NO: 44 - DNA, 1650 bp, Mycobacterium tuberculosis
gtgagccacttgtcgcagcgcatggcggggttgctgcgagttcatggcgagtggtcgcgatccgtggatactagggtggacacggacaacgcgatgcctgcacgttttagcgcccagattcagaatgaggatgaggtgacctccgaccaaggcaacaacggcggcccgaacggcggaggccgcctggcgccgcgcccggtttttcggccaccggtcgacccggcgtcgcgtcaagcgttcgggcgtccgtccggggtccaagggtcctttgtggccgagcgtgtgcgcccgcagaagtaccaggaccagtctgacttcacaccgaacgatcagcttgctgacccggtgcttcaggaggcgttcggtcgtccgttcgcgggcgccgaatcgctgcagcgccatcccatcgatgccggagcgctggcagctgagaaagacggtgccggccccgacgagcccgacgatccgtggcgcgaccccgcggccgcggccgcgctggggacgccagcgctagccgcgccggcaccgcacggtgcgctggccggcagcggcaagctgggtgtgcgcgacgtgctgtttggcggcaaggtgtcctacttggcgctgggcatcttggtcgctatcgcactggtgatcggcggcatcggcggtgtcatcggccgcaagaccgcggaagtagtcgatgcgttcaccacgtcgaaggtgaccctgtcgaccactggcaatgcccaggaaccggccggccggttcaccaaggtggcggccgccgtggccgattcggtggtgaccattgagtcggtcagcgaccaggagggcatgcaaggttccggcgtcatcgtcgatggccgcggctacatcgtcaccaacaatcacgtgatctctgaggcggccaacaatcccagccagttcaagacgaccgtggtgttcaacgacggcaaggaggtgcccgccaatctggtgggtcgtgaccccaagaccgacttggccgtcctcaaggtcgacaacgtcgacaatctgaccgtggcccggctcggtgattccagcaaggtacgggtcggtgacgaagtcctcgcggtcggcgcgcccctggggctgcgcagtacggtgacccagggcattgtcagcgcgctacaccgccccgttccgttgtcgggcgagggctctgacaccgacaccgtcattgacgcaattcagaccgacgcctcgatcaaccacggtaactccggcggtccgctaatcgacatggatgcccaggtgattggcatcaacaccgccggtaagtcactgtcggatagcgccagcgggctgggctttgcgatcccggtcaacgagatgaaattggtggcaaattctctgatcaaagacggaaagatcgtgcatccgacgttgggcatcagcacccggtcagtaagcaacgcgatcgcgtcgggcgcgcaggtggccaatgtaaaggcgggaagtcccgcgcagaagggcgggatcttggagaacgatgtgatcgtcaaggtcggtaaccgcgcggtcgccgactccgacgagttcgtcgtcgccgtgcgccagttggctatcggccaggacgctccgatagaggtggtccgcgagggtcggcatgtgacgctgacggtgaaaccggaccccgatagcacctag

SEQ ID NO: 45 - DNA, 396 bp, Mycobacterium tuberculosis
gtgttcgccaacatcggttggtgggaaatgctcgtcctcgtcatggtcgggctggtggtgcttggcccggagcggctcccgggtgccatccgctgggcggcaagcgctctgcggcaggcgcgcgactatctcagcggtgtgaccagccagctacgtgaggacattggacccgaattcgatgatctgcggggacatctcggtgagctgcagaagctacggggaatgactccgcgggctgcgttgaccaagcacctactggatggcgatgattccctgttcaccggagacttcgaccgaccgacgccgaagaaaccggatgcggcgggctcggcggggccggacgctactgagcagatcggtgcggggcccatcccgtttgacagcgatgccacctag

SEQ ID NO: 46 - DNA, 1173 bp, Mycobacterium tuberculosis
atgccaagccgcctacactcggcggtgatgtccggaactcgtgatggcgacctgaacgcggcgatacgcaccgcgctgggcaaggtaatcgaccccgaattgcggcgccccatcaccgaactggggatggtcaaaagcatcgacaccggcccggatgggagcgtgcacgtcgagatctacctgaccatcgccggctgcccgaagaagtccgaaatcaccgagcgtgtcacccgggcggtcgccgacgtgccaggcacttcggcggtgcgggtcagcttggacgtgatgagcgacgagcagcgcaccgagctgcgtaagcagttgcgtggcgatacccgcgaacccgtcatcccgttcgcgcaacccgattccttgacccgggtgtatgccgtggcttccggtaagggcggagtcggaaagtccaccgtcacggtcaacctggccgccgcgatggccgtccgcggcctgtcgatcggggtgctggacgctgatatccacggccactctatcccccggatgatgggcaccaccgaccggcctacccaggttgagtcgatgatcctgccgccgatcgcccaccaggtgaaggtcatctcgatagcccagttcacccagggcaacaccccggtggtgtggcgcgggccgatgctgcaccgggcgttgcagcagtttctggccgacgtgtactggggggatctggacgtgctgctgctggacttgccgcccggaaccggcgacgtcgccatctcggtggctcaactgatccccaacgccgaactcctggtggtcaccaccccgcagctggccgccgcggaggtggccgaacgggccggcagcatcgcgctgcaaacccgccaacgcatcgtcggcgtcgtggagaacatgtcggggctcacgctgccggacggcaccacgatgcaggtgttcggcgagggcggtggccggctggtcgccgagcggttgtcgcgtgcggtcggcgccgacgtgccgctgctgggtcagatcccgctggaccccgcactggtggccgccggcgattcgggcgtaccgctcgtgttgagctcgccggactcggcgatcggcaaggaactgcatagcatcgccgacggcttgtcgactcgacgacgcggattggcgggcatgtcgctggggttggacccgacacgacgctag

SEQ ID NO: 47 - DNA, 1101 bp, Mycobacterium tuberculosis
gtgttcccagggtttgacgcattgcccgaagtgctgcgaccggtcgcgcgaccccagccgccgaacgcacaccccgttgcccagccaccggcccaagccttggtcgactgcggtgtctacgtctgcggccagcgactgcccggcaagtacacctacgccgccgcgctgcgcgaggtgcgcgagatcgaactgaccgggcaggaggcgttcgtctggatcgggctgcacgagcccgatgaaaaccagatgcaggacgtagcagacgttttcgggttgcacccgttagccgttgaggacgccgtgcacgcgcaccagcgacccaagttggagcgctacgacgagacgctgttcctcgtcctcaagaccgtcaactacgtcccgcacgaatcggtggtactggcccgcgagatcgtcaaaaccggcgagatcatgatcttcgtcggcaaggatttcgtggtcaccgtccgccacggcgaacacggcgggttatccgaggtgcgtaagcggatggatgccgaccccgaacatttgcggttgggaccgtatgcggtgatgcacgcgatcgccgactacgtggtcgaccactacctcgaggtgaccaatctcatggagaccgatatcgacagcatcgaggaagtagcgttcgcgccgggccgcaagctcgacatcgaaccgatctatctgctcaagcgggaagtggtcgagttgcgccggtgcgtgaatccgctatcgaccgcattccagcgcatgcagaccgagagcaaagacctcatttcgaaagaagtgcggcgctacctgcgcgacgtcgccgaccaccagaccgaggccgccgaccagatcgccagctacgacgacatgctcaactcgctggtgcaggccgcgctcgcccgggtcggcatgcagcaaaacatggacatgcgcaagatatccgcgtgggcaggtatcatcgcggtccccaccatgatcgcgggcatctatggcatgaactttcacttcatgcccgagctggactccaggtggggttacccgacagtgatcggcgggatggtccttatctgtctgttcctctaccacgtcttccgcaacagaaactggctctag

SEQ ID NO: 48 - DNA, 1587 bp, Mycobacterium tuberculosis
atggacactcagagcgactacgtcgtggtcggtaccggctcagccggggcggttgtggccagccggcttagcaccgatccggccacgacggtggtggccctggaggcggggccgcgtgacaagaacagattcatcggcgtcccagcggcgttttccaagctgttccgcagcgagatcgactgggattacctaaccgaaccgcagccggagctcgacggccgcgaaatctattggcctcgtggcaaggtgctcggtggctcgtcgtccatgaacgcaatgatgtgggtgcgtggattcgcatcagactacgatgagtgggccgcgcgagccggtccgcggtggtcgtacgccgacgtgctcggctactttcgccgcatcgagaacgtcaccgctgcctggcactttgtcagcggtgacgacagcggagtaaccggtccgttgcatatttcccggcaacgcagcccaagatcggtgaccgcagcgtggctggcagccgcacgtgagtgcggatttgccgctgcgcggccgaattcccctcgaccggaaggcttttgcgagaccgtcgtcacccagcgccgcggtgctcgattcagtactgccgacgcctatctgaagcccgcgatgcgccgtaaaaacctccgtgtgcttaccggcgccactgctacccgggtggtcatcgacggcgaccgggccgtcggcgtggaataccaaagcgacggtcaaacccgcatcgtctacgcccgccgcgaggtggtgctctgcgctggtgccgtcaacagccctcagctgctgatgctctccggcatcggcgaccgcgaccacctcgccgaacacgacatcgacaccgtttaccacgcgcccgaggtcgggtgcaacctgctcgatcatctcgtcacggtgctgggtttcgacgtcgaaaaggacagcttgtttgccgccgagaagcccggccagttgatcagctacttactgcgacgccgcggcatgctcacctccaacgtcggcgaggcgtacggatttgtccgcagccgacccgaactgaagctgcccgatttggagttgatttttgccccggcgccgttttacgacgaagcgctggttccaccggctggtcacggtgtggtattcggcccgattctggtcgcgccgcaaagccgtggccagatcacgctgcggtccgccgatccgcatgccaagcctgtcatcgaaccgcgttacctgtccgatctcggtggcgtagaccgggccgccatgatggcgggcctgcggatatgcgcgcggatcgcgcaggcccgcccgctcagagatctccttgggtccatcgcgcgaccgcgcaacagcaccgagctggacgaggccactctcgagttggcgctggccacttgttcgcacaccctgtaccacccgatgggcacctgccgcatgggcagcgacgaggccagcgtggtggatccgcagctgcgggtccgcggtgtcgacggactccgcgtcgccgacgcgtcggtgatgcccagcacggttcgtgggcatacgcatgcgccgtcggtgctgatcggggagaaggccgccgacttaatccgcagctga

SEQ ID NO: 49 - DNA, 1326 bp, Mycobacterium tuberculosis
gtgcccggtgacgaaaagccggtcggcgtagcggtactcggtttgggcaacgtcggcagcgaggttgtccgcatcatcgagaacagcgccgaggatctcgcggctcgtgtcggtgccccattggtcctgcggggcatcggcgtgcgccgcgtgacgaccgatcgcggcgtgccgatcgaattgttgaccgacgacattgaagagctcgtggcccgcgaggatgtcgatatcgtggtggaagtgatggggccggtggaaccgtcgcgcaaggcgatcctgggcgcccttgagcgcggcaagtccgtcgttacggcgaacaaggctttactcgccacctccaccggcgaattggcacaggccgccgaaagcgcccatgttgatctgtatttcgaggcggccgtggcgggcgccattccggtcatccgtccgctcacccagtcgctggccggcgacacggtgctgcgagtggccgggatcgtcaacggcaccaccaactacatcctctcggcgatggacagcaccggcgctgactatgccagcgccctggccgacgcaagtgcgctgggctatgcggaggctgatcccaccgcagacgtcgaaggctacgacgccgcggccaaggcagcgatcctggcatccattgccttccacacccgggtgaccgcagacgacgtgtatcgcgaaggcatcaccaaggtcactccggccgacttcggatccgcgcacgcgctgggttgcaccatcaaactgctgtcgatctgtgagcgcataaccaccgacgaaggttcgcagcgggtatcggcccgcgtctatccggccctggtacctctgtcgcatccgcttgccgcggtcaacggcgcgttcaatgccgtggtggtcgaggccgaggccgcgggccggctgatgttctacggccagggcgcgggcggcgcgccgaccgcctctgcggtgaccggtgacctagtgatggccgcccgcaaccgggtactcggcagccgcggcccccgtgagtctaaatacgctcaacttccggtggcaccaatgggtttcattgaaacgcgctattacgtcagcatgaacgtcgccgacaagccgggcgtcttgtccgcggtggcggcggaattcgccaaacgcgaggtgagcatcgccgaggtgcgccaggagggcgttgtggacgaaggtggtcgacgggtgggagcccgaatcgtggtggtcacgcacctcgccactgacgccgcactctcggaaaccgttgatgcactggacgacttggatgtcgtgcagggtgtgtccagcgtgatacgactggaaggaaccggcttatga

SEQ ID NO: 50 - DNA, 1170 bp, Mycobacterium tuberculosis
gtgattgttgctggcgcgcgtacacccatcggcaagttgatgggctccctgaaggatttcagcgccagcgagctgggtgccatcgccattaagggcgccctggagaaggccaacgtgccggcgtccttggtcgagtacgtgatcatgggccaggtgttgaccgcgggtgccgggcaaatgcccgcacggcaggcggcagtggcggccggcatcggttgggatgtccctgcgctgacgatcaacaagatgtgcctgtccggcatcgacgcaatcgcgctggctgatcaactcattcgggccagagagttcgacgtggtggtggccggcggtcaggagtcgatgacgaaggcgccccacctgttgatgaatagccggtcgggttacaagtacggcgacgttacggttttggaccacatggcctacgacggtctgcacgacgtgttcaccgatcagccgatgggcgcgctcaccgagcaacgcaacgacgtcgacatgttcacccgctccgaacaggacgagtacgcggctgcgtcccaccaaaaggcggccgcggcatggaaggacggcgtattcgccgacgaggtgatcccggtgaacatcccgcagcgcacgggcgatccactgcagttcaccgaggacgaggggatccgcgccaacaccaccgccgccgcgctggccggtctgaagccggcgttccgtggcgacggcaccatcaccgccgggtcggcgtcacagatctccgacggtgcggccgcggtggtggtcatgaaccaggaaaaggcccaggaactggggctgacctggctagccgagatcggcgcccacggtgtggtggccgggccggattccacactgcaatcgcagccggccaacgcgatcaacaaggcgctggatcgcgagggcatctcggtggaccagctcgacgtggtggagatcaacgaggcgttcgctgcggtggcattggcctcgatacgcgaactcgggctgaacccccagatcgtcaacgtcaacggtggtgcgattgccgtcgggcatcccctcggcatgtcagggacgcgaatcacgctacatgcggcgctgcagttggcacgccggggatcgggcgtcggggttgccgcattgtgcggggctggcgggcagggcgacgcactgatattgcgggccggatag

SEQ ID NO: 51 - DNA, 627 bp, Mycobacterium tuberculosis
gtgagcgtcggcgagggaccggacaccaagcccaccgcgcgtggccaaccggcggcagtgggacgtgtggtggtgctgtccggtccttccgcggtcggcaaatccacggtggttcggtgtctgcgcgagcggatcccgaatctgcatttcagtgtctcggccacgacgcgggcgccacgcccgggcgaggtcgacggtgtcgactaccacttcatcgaccccacccgctttcagcagctcatcgaccagggtgagttgctggaatgggcagaaatccacggcggcctgcaccggtcgggcactttggcccagccggtgcgggcggccgcggcgactggtgtgccggtgcttatcgaggttgacctggccggggccagggcgatcaagaagacgatgcccgaggctgtcaccgtgtttctggcgccacctagctggcaggatcttcaggccagactgattggccgcggcaccgaaacagctgacgttatccaacgccgcctggacaccgcgcggatcgaattggcagcgcagggcgactttgacaaggtcgtggtgaacaggcgattagagtctgcgtgtgcggaattggtatccttgctggtgggaacggcaccgggctccccgtga

SEQ ID NO: 52 - DNA, 1374 bp, Mycobacterium tuberculosis
atgacccctagatcgcgtgggccgcgccgccggccgctggacccggcgcgtcgtgcggccttcgagacgctgcgggcggttagtgcgcgcgacgcctacgcgaacctggtgttgcccgcgctgctggcccaacgcggtatcggcggtcgcgacgccgcgttcgccaccgagctgacatacggcacctgccgagcccgcggcctgctcgacgcggtcatcggtgcggccgccgagcgttcgccgcaggcgatcgatccggtgctgctagacctgttgcggctcggcacctaccaattgctgcgcacgcgggtcgacgcacacgccgcagtgtcgaccaccgtcgagcaggccggaatcgaattcgattcggcgcgagcaggtttcgtcaacggtgtactacgaacgatcgccggccgagacgagcggtcctgggttggcgaactcgctcctgatgcgcagaacgatccgatcgggcatgccgcgttcgtgcatgcgcatccccgatggatcgcccaggcctttgctgacgcgttgggcgcggcggtcggggagctcgaggcagttttggccagcgacgacgaacggccagcggtgcacctggcggcacgccccggggtgctgaccgccggcgaactggcccgcgcggtgcgcggaaccgtcggtcggtattcgccgtttgcggtgtatctgccgcgcggtgacccggggcgactggcgccggtgcgcgacggccaagcgctggtccaggacgagggcagccagttagtcgcccgagcattgaccctggcgccagtcgacggcgataccggacggtggctggacctgtgtgccggaccgggcggcaagaccgcgctgttggccgggctgggtttgcagtgcgcagcccgggtgaccgcggtggaaccctcgccacaccgcgcggacctggtagcacagaacacccgcgggctgccggttgagctcttgcgtgtcgacgggcggcacaccgacctcgacccgggtttcgaccgggtgctggtggatgcgccctgcaccgggctgggcgcgttacgccgtcggccggaggcccgttggcgtcgtcagccggcggacgtagcggcactggccaagctacaacgcgagttgttgagcgccgccatcgcgctgactcggcccggcggtgtcgtgctctatgccacatgctcgccgcacctggccgagactgtgggtgctgtcgccgacgcgctacgccgacatccggttcacgcgctcgatacccgcccactgttcgagccggtgatcgcggggctgggggaggggccccacgttcagctgtggccgcaccggcacggtaccgacgccatgttcgccgcggcgttgcgccgcctgacgtga

SEQ ID NO: 53 - DNA, 1020 bp, Mycobacterium tuberculosis
atgaacgtggagcaggtcaagagcatcgacgaggctatgggtctcgccatcgagcactcctaccaggtcaaaggcacgacttatccaaaacccccagtgggggccgtcattgtggatcccaacggtcggatcgtcggcgccggcggcaccgagccggccggtggcgatcatgccgaggtggtggcgctgcgccgggccggcggattggctgccggcgccatcgtggtggtcaccatggaaccctgtaaccactacggcaagactccgccatgcgtgaacgctctgatcgaagccagggtggggacggtggtctacgccgtcgccgacccgaacgggatcgctgggggtggcgcgggccggctgtcagcagcgggcctacaggtgcggtccggggtgttggctgaacaggtggcggccggaccgctgcgggagtggctccacaagcaacgcaccggtctgccgcatgtcacctggaagtacgccaccagcatcgacggccgcagcgccgccgccgacggctccagccagtggatctccagcgaggccgcacgcctggatctgcatcgccgccgcgccatcgccgacgcgatcttggtcggcaccggcaccgtcctcgccgacgacccggccctgaccgcgcggctggccgacggctcgctggcgccgcagcagccgctgcgcgtggtggtgggcaagcgcgacataccgccggaagcacgggtcctcaacgacgaggcacgcaccatgatgatccgcacccacgaacctatggaggtgctcagggcgttgtcggatcgcaccgacgtgctgctggaaggaggtcccaccctcgccggcgccttcctacgagcgggtgcgatcaaccggatcctggcctacgtcgcaccgatcctgttgggcggtccggttaccgcggtcgatgacgtcggggtgtccaacatcaccaacgcgttgcgttggcagttcgacagcgtcgaaaaggtcggaccggatctgttgctgagcttggtggctcgttag

SEQ ID NO: 54 - DNA, 354 bp, Mycobacterium tuberculosis
gtggcaggcgtgacagccgcggtcagtgcacgcctcaaagccgatgaggcgcgacggcctgggttctacgcggcaggcagcggtccgctgccgcaggttcgggggagtacgctacccgtcatggaattggccctgcagatcacgctgatcgtcacgagcgtgctggtggtgttgttagtactgctgcaccgggccaagggtggcgggctatcgacactgttcggcggtggtgtgcagtcaagcctgtccggctcgacggtggtggagaagaacctggaccggttgacgctgttcgttaccggcatctggctggtgtccatcatcggcgtggcgttgctcatcaaataccgctag

SEQ ID NO: 55 - DNA, 810 bp, Mycobacterium tuberculosis
atgacaggactgctggacggcaaacggattctggttagcggaatcatcaccgactcgtcgatcgcgtttcacatcgcacgggtagcccaggagcagggcgcccagctggtgctcaccgggttcgaccggctgcggctgattcagcgcatcaccgaccggctgccggcaaaggccccgctgctcgaactcgacgtgcaaaacgaggagcacctggccagcttggccggccgggtgaccgaggcgatcggggcgggcaacaagctcgacggggtggtgcattcgattgggttcatgccgcagaccgggatgggcatcaacccgttcttcgacgcgccctacgcggatgtgtccaagggcatccacatctcggcgtattcgtatgcttcgatggccaaggcgctgctgccgatcatgaaccccggaggttccatcgtcggcatggacttcgacccgagccgggcgatgccggcctacaactggatgacggtcgccaagagcgcgttggagtcggtcaacaggttcgtggcgcgcgaggccggcaagtacggtgtgcgttcgaatctcgttgccgcaggccctatccggacgctggcgatgagtgcgatcgtcggcggtgcgctcggcgaggaggccggcgcccagatccagctgctcgaggagggctgggatcagcgcgctccgatcggctggaacatgaaggatgcgacgccggtcgccaagacggtgtgcgcgctgctgtctgactggctgccggcgaccacgggtgacatcatctacgccgacggcggcgcgcacacccaattgctctag

SEQ ID NO: 56 - DNA, 1419 bp, Mycobacterium tuberculosis
gtgacgagacgcgggaaaatcgtctgcactctcgggccggccacccagcgggacgacctggtcagagcgctggtcgaggccggaatggacgtcgcccgaatgaacttcagccacggcgactacgacgatcacaaggtcgcctatgagcgggtccgggtagcctccgacgccaccgggcgcgcggtcggcgtgctcgccgacctgcagggcccgaagatcaggttgggacgcttcgcctccggggccacccactgggccgaaggcgaaaccgtccggatcaccgtgggcgcctgcgagggcagccacgatcgggtgtccaccacctacaagcggctagcccaggacgcggtggccggtgaccgggtgctggtcgacgacggcaaagtcgcattggtggtcgacgccgtcgagggcgacgacgtggtctgcaccgtcgtcgaaggcggcccggtcagcgacaacaagggcatctcgttgcccggaatgaacgtgaccgcgccggccctgtcggagaaggacatcgaggatctcacgttcgcgctgaacctcggcgtcgacatggtggcgctttccttcgtccgctccccggccgatgtcgaactggtccacgaggtgatggatcggatcgggcgacgggtgccggtgatcgccaagctggagaagccggaagccatcgacaatctcgaagcgatcgtgctggcgttcgacgccgtcatggtcgctcggggcgacctaggtgttgagctgccgctcgaagaggtcccgctggtacagaagcgagccatccagatggcccgggagaacgccaagccggtcattgtggcgacccagatgctcgactcgatgatcgagaactcgcggccgacccgagctgaggcctccgacgtcgccaacgcggtgctcgatggcgccgacgcgctgatgctgtccggggaaacctcggtagggaagtacccccttgctgcggtccggacaatgtcgcgcatcatctgcgcggtcgaggagaactccacggccgcaccgccgttgacacacattccccggaccaagcgtggggtcatctcgtatgcggcccgtgacatcggcgaacgactcgacgccaaggccttggtggccttcactcagtccggtgataccgtgcggcgactggcccgcctgcataccccgctgccgctgctggccttcaccgcgtggcccgaggtgcgcagccaactggcgatgacctggggcaccgagacgttcatcgtgccgaagatgcagtccaccgatggcatgatccgccaggtcgacaaatcgctgctcgaactcgcccgctacaagcgtggtgacttggtggtcatcgtcgcgggtgcgccgccaggcacagtgggttcgaccaacctgatccacgtgcaccggatcggggaagatgacgtctag

SEQ ID NO: 57 - DNA, 1446 bp, Mycobacterium tuberculosis
atgccgagtcccaccgtcacctcgccgcaagtagccgtcaacgacataggctctagcgaggactttctcgccgcaatagacaaaacgatcaagtacttcaacgatggcgacatcgtcgaaggcaccatcgtcaaagtggaccgggacgaggtgctcctcgacatcggctacaagaccgaaggcgtgatccccgcccgcgaactgtccatcaagcacgacgtcgaccccaacgaggtcgtttccgtcggtgacgaggtcgaagccctggtgctcaccaaggaggacaaagagggccggctcatcctctccaagaaacgcgcgcagtacgagcgtgcctggggcaccatcgaggcgctcaaggagaaggacgaggccgtcaagggcacggtcatcgaggtcgtcaagggtggcctgatcctcgacatcgggctgcgcggtttcctgcccgcctcgctggtggagatgcgccgggtgcgcgacctgcagccctacatcggcaaggagatcgaggccaagatcatcgagctggacaagaaccgcaacaacgtggtgctgtcccgtcgcgcctggctggagcagacccagtccgaggtgcgcagcgagttcctgaataacttgcaaaaaggcaccatccgaaagggtgtcgtgtcctcgatcgtcaacttcggcgcgttcgtcgatctcggcggtgtggacggtctggtgcatgtctccgagctatcgtggaagcacatcgaccacccgtccgaggtggtccaggttggtgacgaggtcaccgtcgaggtgctcgacgtcgacatggaccgtgagcgggtttcgttgtcactcaaggcgactcaggaagacccgtggcggcacttcgcccgcactcacgcgatcgggcagatcgtgccgggcaaggtcaccaagttggttccgttcggtgcattcgtccgcgtcgaggagggtatcgagggcctggtgcacatctccgagctggccgagcgtcacgtcgaggtgcccgatcaggtggttgccgtcggcgacgacgcgatggtcaaggtcatcgacatcgacctggagcgccgtcggatctcgttgtcgctcaagcaagccaatgaggactacaccgaggagttcgacccggcgaagtacggcatggccgacagttacgacgagcagggcaactacatcttccccgagggcttcgatgccgaaaccaacgaatggcttgagggattcgaaaagcagcgcgccgaatgggaagctcggtacgccgaggccgagcgccggcacaagatgcacaccgcgcagatggagaagttcgccgccgccgaggcggctggacgcggcgcggacgatcagtcgtcggccagtagcgcaccgtcggaaaagaccgcgggtggatcactggccagcgacgcccagctggcggccctgcgggaaaaactcgccggcagcgcttga

SEQ ID NO: 58 - DNA, 1224 bp, Mycobacterium tuberculosis
atgctgcgcatcgggctgaccggcggcattggcgccgggaagtcgttgctgtccacgacgttctcgcaatgcggcggaatcgttgtcgacggcgatgtgttggcgcgtgaagtggtccagccgggcaccgaggggctggcctcgctggtcgacgcgttcggtcgcgacatcctgcttgcagacggagcgctggaccggcaggcgttggcggccaaggcgtttcgagatgacgagtcgcgcggtgtgctcaacggaatcgtgcacccgctggtcgcccggcgccgatccgagatcatcgcggcggtttcgggggacgcggttgtggtcgaagatattccactgctggtggaatccgggatggcgccattgtttccgctggtggtggtggtgcacgccgacgtcgagctacgggtgcgacggctggtcgagcaacgcggcatggccgaagccgacgcccgggctaggatcgctgcgcaggccagcgaccagcagcgtcgtgccgtcgccgacgtctggctggacaactcgggcagcccagaggatttggtgcggcgggcccgcgacgtctggaacacgcgcgtccagcccttcgcgcacaacctggcccaacgtcagattgcgcgcgcgccggctaggttggtgccggcggatccaagctggccggatcaggcgcggcgcatcgtcaaccggctaaagatcgcgtgcgggcataaggccttgcgagttgaccacattgggtcaaccgccgtgtcgggcttccccgattttctagccaaggatgtcatcgacatccaggtcaccgtcgaatcacttgacgtggccgacgagctggccgagcccttgctggccgccggctacccacgcctcgagcacatcacccaggacaccgaaaagaccgacgctcgcagcaccgtcggccgctacgaccacaccgacagtgccgctctgtggcacaagcgcgtgcacgcctcggcggatcccggtcggccgaccaacgtgcacctgcgggtgcacggctggcccaaccaacagttcgccctgctgttcgtcgactggctggcggccaatcccggcgcgagagaagactatttgacggtcaagtgtgacgccgacaggcgcgccgacggtgagctcgcgcgctacgtcaccgccaaggagccgtggttcctggatgcctaccagcgggcatgggagtgggcggatgcggtgcactggcgtccctga

SEQ ID NO: 59 - DNA, 1185 bp, Mycobacterium tuberculosis
atgaccctcgatgtcccggtcaaccaggggcatgtccccccgggcagcgtcgcctgctgccttgttggggtcaccgccgttgctgacggcatcgccgggcattccctgtccaactttggggcgttacctcccgagatcaattcgggtcgtatgtatagcggtccgggatccgggccactgatggctgccgcggcggcctgggacgggctggccgcagagttgtcgtcggcagcgactggctacggtgcggcgatctcggagctgacaaacatgcggtggtggtcggggccggcatcggattcgatggtggccgccgtcctgccctttgtcggctggctgagtaccaccgcgacgctagccgaacaggccgcgatgcaggctagggcggccgcagcggcctttgaagccgccttcgccatgacggtgcccccgccggcgatcgcggccaaccggaccttgttgatgacgctcgtcgataccaactggttcgggcaaaacacgccggcgatcgccaccaccgagtcccaatacgccgagatgtgggcccaagacgccgccgcgatgtacggctatgccagcgccgcggcacccgccacggttttgactccgttcgcaccaccgccgcaaaccaccaacgcgaccggcctcgtcggccacgcaacagcggtggccgcgctgcgggggcagcacagctgggccgcggcgattccatggagcgacatacagaaatactggatgatgttcctgggcgccctcgccactgccgaagggttcatttacgacagcggtgggttaacgctgaatgctctgcagttcgtcggcgggatgttgtggagcaccgcattggcagaagccggtgcggccgaggcagcggccggcgcgggtggagccgctggatggtcggcgtggtcgcagctgggagctggaccggtggcggcgagcgcgactctggccgccaagatcggaccgatgtcggtgccgccgggctggtccgcaccgcccgccacgccccaggcgcaaaccgtcgcgcgatcgattcccggtattcgcagcgccgccgaggcggctgaaacatcggtcctactccggggggcaccgactccgggcaggagtcgcgccgcccatatgggacgccgatatggaagacgactcaccgtgatggctgaccggccgaacgtcggatag

SEQ ID NO: 60 - DNA, 612 bp, Mycobacterium tuberculosis
atgacccgcagctaccggccagctccaccgatcgagcgggtggttttgctcaacgaccgcggcgacgcgacaggtgtggccgacaaggccaccgtgcacaccggcgacacccctttgcacctcgcgttctccagctatgtgttcgatctgcacgatcagctgttgatcacgcggcgggccgccaccaagaggacgtggccggcggtatggaccaacagttgctgcgggcaccccctgcctggcgaatcgctacccggcgccatacgccggcggctcgctgccgaactcggactgaccccagatcgggtcgatctgatcctgccggggttccgctaccgggccgctatggccgatggcaccgtggaaaacgagatctgccccgtctaccgagtccaggttgaccaacagccccggccgaactcggacgaggtcgacgcgatccgctggttgtcctgggaacaattcgtgcgcgatgttaccgccggcgtaatcgccccggtatccccttggtgccgctcacaactgggctacctgaccaaacttggaccatgtccggcacagtggcccgtggccgacgactgccggctaccgaaagccgcacatggtaattaa

SEQ ID NO: 61 - DNA, 1968 bp, Mycobacterium tuberculosis
atgctgccgaatttcgcggtgctgccccccgaggtcaattcggcgagggtgttcgccggtgcggggtcggcgccgatgttagcggcagcggccgcctgggatgatctagcctccgagctgcattgtgctgcaatgtcattcgggtcggttacgtcgggattggtggttgggtggtggcagggatcggcgtcggcggcgatggtggacgcagccgcgtcgtacatcgggtggctgagcacgtcggctgcccacgccgagggcgcggccggtctggctcgggccgcggtatcggtgttcgaggaggcgctggccgcgacggtgcatccggcgatggttgcggcaaatcgcgcccaggtggcgtcgctggtagcgtcgaacttgtttgggcagaacgcgcctgcgatcgccgcgctcgaatccttgtatgagtgtatgtgggcccaggatgcagcggccatggcgggttattacgttggggcttcggcggtggccacacagttggcatcgtggctgcaacggctacagagcatccccggcgccgccagtcttgatgcccgtctgccgagctcggccgaggcaccgatgggagtcgtccgcgcggtcaacagcgcgatcgccgccaatgcggctgcggcacaaaccgttggcctggtcatgggaggcagcggcacgccaataccgtcggccagatatgtcgagctcgcgaacgcgctgtacatgagtggcagcgtcccgggtgttatcgcgcaggcgctcttcacgccccaagggctctacccggtggtcgtgatcaagaacctcactttcgattcctcggtggcgcagggtgccgtcattctcgaaagtgcgattcggcagcaaattgccgccggcaacaacgtcaccgtcttcggctactcgcagagcgccacgatctcgtcactagtgatggccaatcttgcggcttcggccgacccgccgtctccagacgagctttccttcacgctgatcggcaatcccaacaaccccaatggcggggttgccaccaggttcccggggatctcctttccaagcttgggcgtgacggccaccggggccactccgcacaatctgtacccgaccaagatctacaccatcgaatacgacggcgtcgccgactttccgcggtacccgctcaactttgtgtcgaccctcaacgccattgccggcacctactacgtgcactccaactacttcatcctgacgccggaacaaattgacgcagcggttccgctgaccaatacggtcggtcccacgatgacccagtactacatcattcgcacggagaacctgccgctgctagagccactgcgatcggtgccgatcgtggggaacccactggcgaacctggttcaaccaaacttgaaggtgattgttaacctgggctacggcgacccggcctatggttattcgacctcgccgcccaatgttgcgactccgttcgggttgttcccagaggtcagcccggtcgtcatcgccgacgctctcgtcgccgggacccagcagggaatcggcgatttcgcctacgacgtcagccacctcgaactgccgttgccggcagacgggtcgacgatgccaagcaccgcaccgggctcgggtacgccggtccccccgctctcgatcgacagcctgatagacgacctgcaggtggctaaccgcaacctcgccaacacgatttcgaaggtggccgcgacgagctacgcgacggtgctcccaaccgccgacatcgccaatgcggcgttgacgatcgtgccgtcgtacaacatccacctttttttggagggcatccagcaagcgctcaagggcgacccgatgggactcgtcaacgcggtcggatacccactcgcggccgacgtggcactgttcacggccgcaggcggtcttcagctcttgatcatcatcagcgcgggccgaacgattgccaatgacatctcggccattgtcccctga

SEQ ID NO: 62 - DNA, 1458 bp, Mycobacterium tuberculosis
atgagttcgtcggaatcgccagccggcatcgcgcagatcggcgtcactggcctggccgtgatgggttccaacatcgcccgaaacttcgcccggcacggctacaccgtggcagtgcacaatcggtcggtcgccaagaccgacgcgctgcttaaggagcacagctcagacggcaagttcgtgcgcagtgaaacgatccccgaatttcttgccgcactggaaaaaccgcgtcgggtgctgatcatggtcaaggccggagaggccactgacgctgacgctgtcatcaacgaacttgctgacgccatggaacccggcgacatcatcatcgacggcggcaatgcgttgtacaccgacaccatgcgccgcgagaaagcgatgcgtgagcggggcttgcacttcgtcggggccgggatctccggcggcgaagagggcgcgttgaacgggccgtcgatcatgcccggcggacccgccgagtcataccaatcgctgggtccgctgctcgaggagatctccgcgcatgtcgacggcgtgccgtgctgcacccacattggcccggacggctccgggcacttcgtcaagatggtccacaacggcatcgagtactccgacatgcagctcatcggtgaggcctaccagctgatgcgcgacgggctaggtctgaccgcgccggcgatcgccgatgtgttcaccgagtggaacaatggcgatctggacagctacctggtcgagatcaccgccgaggtgctgcggcagaccgatgccaagaccggcaaaccgctcgtcgacgtcatcgtggaccgggccgagcagaaaggcaccggccgttggaccgtcaagtccgcgctggacctgggtgtgccggtgaccggcatcgccgaagcggtgtttgcccgcgctctctcgggatccgtggggcaacgctcggccgccagcggtctggcttcgggcaagctcggcgagcagcccgccgaccccgccacgttcaccgaagacgtccgccaggcgttgtacgcctccaagatcgtggcctacgctcagggcttcaaccagatccaggccggcagcgccgaattcggctgggacatcacgccgggcgacctggccaccatctggcgtggcggctgcatcatccgggcgaagttcctcaaccacatcaaggaagcctttgacgccagcccgaacctggccagtctgattgtggccccgtatttccgcggcgccgtcgaatcggcgatcgacagttggcggcgtgtggtgtcgacggcggcccaactgggtatcccgaccccgggattctcgtcggccctgtcgtattacgacgcgctgcgcaccgcgcggctgcccgctgcactcacccaggcccagcgcgacttcttcggcgcacacacctacggccggatcgacgaaccaggcaagttccacacactatggagttcagaccgcaccgaagtaccggtgtag

SEQ ID NO: 63 - DNA, 1389 bp, Mycobacterium tuberculosis
gtggcgcaggctccccacattcacaggacccgctacgcaaaatgcggcgacatggatatcgcctaccaggtgctgggtgacggtccgacggatctgctggtgttgccggggccgttcgtgccgatcgactcgatcgacgacgagccatcgctgtaccgtttccatcgccgtcttgcgtcattcagcagggtgatccgcctcgaccatcgtggggtcggcctgtcgtcacggctcgccgcgataaccacgctggggccgaagttctgggcccaggacgcgatcgcggtgatggacgcggtcggatgcgagcaggcgacaattttcgcgcccagtttccacgccatgaacggacttgttctcgccgccgactaccccgagcgggtgcgcagcctgatcgtcgtcaacggctcggcgcgcccactatgggcgcccgactacccggtaggcgcccaggttcgtcgagctgacccgttcctgacggtggcgctggaaccggatgccgtcgagcggggcttcgacgtgctgagcatcgtggctcctaccgtggccggagatgacgtgtttcgagcctggtgggatctcgccggcaaccgtgccggaccgccgagcattgcccgtgccgtttcaaaggtcatagccgaggccgacgtacgagatgtcttgggacacatcgaggctccaacactgatcttgcaccgtgtcggatcgacgtacatcccggtgggacatggtcgctacctcgccgagcacatcgctggatcccgcttggtcgaactacccggcaccgataccctgtactgggttggcgacaccgggccgatgctcgatgaaatcgaggaattcatcaccggcgtgcgcggcggcgctgacgccgagcgcatgcttgccaccatcatgtttaccgacatcgtcggctcgacccagcacgccgccgcgctcggcgacgaccgatggcgcgacctgttggacaaccacgacaccatcgtgtgccacgaaatccagcggttcggcggtcgcgaagtgaacacggccggtgacggtttcgtcgcgacgttcaccagtccgagtgccgcgatcgcgtgcgcggacgacatcgtcgacgcggtcgccgcgctgggtattgaggtccggatcggtattcatgcgggcgaggtcgaggtgcgcgatgcctcgcacggtaccgacgtcgccggcgtggccgtgcatatcggtgcgcgcgtctgcgcgctggccggacccagtgaggtgctggtgtcctcgaccgtgcgagacatcgtcgccggatcacggcaccggttcgccgagcgtggtgagcaggaactcaagggcgtaccgggcagatggcggctatgcgtgctcatgcgcgacgacgccacccgcacgcgctaa

SEQ ID NO: 64 - DNA, 1029 bp, Mycobacterium tuberculosis
atgagggagaacctggggggcgtcgtggtgcgcctcggcgtcttcctggcggtatgcctgctgacggcgttcctgctgattgccgtcttcggggaggtgcgcttcggcgacggcaagacctactacgccgagttcgccaacgtgtccaatctgcgaacgggcaagctggtgcgcatcgccggcgtcgaggtcggcaaggtcaccaggatctccatcaaccccgacgcgacggtgcgggtgcagttcaccgccgacaactcggtcaccctcacgcggggcacccgggcggtgatccgctacgacaacctgttcggtgaccgctatttggcgctggaggaaggggccggcggactcgccgttcttcgtcccggtcacacgattccgttggcgcgcacccaaccggcgttggatctggatgccctgatcggtggattcaagccgctgtttcgtgcgctgaaccccgagcaggtcaacgcgctgagcgaacagttgctgcacgcgtttgccggacaggggcccacgatcgggtcattgctggcccagtccgcggccgtgaccaacaccctggccgaccgtgatcggctgatcgggcaggtgatcaccaacctcaacgtggtgctgggctcgctgggcgctcacaccgatcggttggaccaggcggtgacgtcgctatcagcgttgattcaccggctcgcgcaacgcaagaccgacatctccaacgccgtggcctacaccaacgccgccgccggctcggtcgccgatctgctgtcgcaggctcgcgcgccgttggcgaaggtggttcgcgagaccgatcgggtggccggcatcgcggccgccgaccacgactacctcgacaatctgctcaacacgctgccggacaaataccaggcgctggtccgccagggtatgtacggcgacttcttcgccttctacctgtgcgacgtcgtgctcaaggtcaacggcaagggcggccagccggtgtacatcaagctggccggtcaggacagcgggcggtgcgcgccgaaatga

SEQ ID NO: 65 - DNA, 666 bp, Mycobacterium tuberculosis
atgtcgcgtcgagcatcggccacgtgtgccttgtccgcgaccaccgccgtcgccataatggctgctcccgccgcacgggccgacgacaagcggctcaacgacggcgtggtcgccaacgtctacaccgttcaacgtcaggccggctgcaccaacgacgtcacgatcaacccgcaactacaattggccgcccaatggcacaccctcgatctgctgaacaaccggcacctcaacgacgacaccggttctgacggatccacaccgcaagaccgcgcgcatgccgccggcttccgcgggaaagtcgctgaaaccgtggcgatcaatcccgccgtagcgatcagcggcatcgagttgataaaccagtggtactacaaccccgcgtttttcgcgatcatgtccgactgcgccaacacccagatcggggtgtggtcagaaaacagcccggatcgcaccgtcgtggtggccgtttacggacagcccgatcgaccttccgcgatgccgcccaggggagcggtaaccggaccgccgtccccggtggccgcgcaagagaacgttcctatcgaccccagccccgactacgacgccagcgacgagatcgaatacggcatcaactggctgccatggatcctgcgcggcgtgtacccgccgcccgcaatgccgccgcagtag

SEQ ID NO: 66 - DNA, 969 bp, Mycobacterium tuberculosis
atgaccggcaagctcgttgagcgggtgcacgcaatcaattggaaccggttgctcgatgctaaagatttgcaggtctgggaacgtttgaccggtaacttttggttgccggaaaagattccgctctccaacgacctggcatcttggcaaacgttgagttccaccgagcagcagacgacgatccgggtgttcaccggcttgaccctgctcgacaccgcgcaggcgacggtgggagcagtggccatgatcgacgacgcggtcaccccccacgaagaggcggtcctgaccaacatggcgttcatggagtcagtgcacgccaagagctacagctcgatcttctcgaccctgtgctcgaccaagcagatcgacgatgccttcgactggtcggaacagaacccttacctgcagcgaaaagcgcagatcatcgtcgactactaccgcggtgacgacgcgctcaagcgcaaagcatcgtcggtaatgctggagtccttcctgttctactccggcttctacctgcccatgtactggtcgtcgcggggtaagctcaccaacaccgccgatctgatccggctgatcatccgagatgaagccgtccacggctactacatcggctacaaatgtcaacgaggtttggccgacctgaccgacgccgagcgggccgaccaccgcgaatacacctgcgagctgctgcacacgctctacgcgaacgagatcgactatgcgcacgacttgtacgacgagttgggctggaccgacgacgttttgccctacatgcgttacaacgccaacaaggcgctagccaacctgggataccagcctgcattcgatcgtgacacctgccaggtgaacccggccgtgcgcgcagctctcgaccccggtgcaggggagaaccacgactttttctccggctccggaagctcatacgtaatgggcacccaccaacccaccaccgacaccgactgggacttctaa

SEQ ID NO: 67 - DNA, 2721 bp, Mycobacterium tuberculosis
gtgactgagctggccgagctggaccggttcaccgcggaactaccgttctcgctcgacgactttcagcagcgggcttgcagcgcgctggaacgcggccacggtgtgctggtgtgcgcgccgaccggcgctggcaagacggtggtcggcgagttcgccgtgcacctggcgctggcggccggcagtaaatgtttctacaccacgccgctgaaagccctgagcaaccaaaagcacaccgatctcacagcacgctacggccgtgaccagatcgggctgctgaccggtgacctgtcggtcaacggcaacgcgccggtggtggtgatgaccaccgaagtgctgcgcaacatgctctacgcggattcgcctgcgctgcaggggctttcctatgtggtgatggatgaggtgcatttcctcgccgaccggatgcggggtccggtgtgggaggaggtgatcctgcaactgcccgacgacgtgcgggtggtcagcctgtcggcgacggtgagcaacgccgaggagttcggcggttggatccagacggtgcggggcgacaccacggtggtggtcgacgagcatcggccggtgccgttgtggcaacacgtcttggtgggcaagcgcatgttcgacctgttcgattaccggatcggcgaagccgaagggcagccccaagtcaaccgcgagttgctgcgccacatcgcgcatcgccgtgaggccgaccggatggccgattggcagcctcggcgccgaggctcgggccggcccggcttctaccggccacccggccgacccgaggtgatcgccaaactcgacgctgaagggctgttgccggcgatcaccttcgtgttctcccgggccggttgtgacgccgcggtcacccaatgcctgcggtcaccgctgcggttgaccagcgaagaggagcgcgcacggatcgccgaggtgatcgaccaccgctgcggtgacctggccgactccgacctggcggtactcggctactacgaatggcgggaagggttactgcgcggtctggccgcccaccacgcgggcatgttgccggccttccggcacacggtggaggagctgttcaccgccggtttggtcaaggctgtattcgccaccgagactctggcgctcggtatcaacatgccggcccgcacggtggtgctggagcggctggtgaagttcaacggtgagcagcacatgccgctgacgccgggggagtacacccaactgaccggtcgcgccggccggcgcggtatcgacgtcgagggtcacgcggtggtgatctggcacccggaaattgaaccgtccgaggtggcgggcctggcctccacccgcacctttccgctgcgcagctcgtttgccccgtcgtacaacatgacgatcaacctggtgcaccggatgggtccgcaacaggcgcaccgactgctcgagcagtcgttcgcccaatatcaggccgaccgatccgtggtcggactggtccgcggaattgagcggggcaacaggatactcggcgagatcgcagccgaactgggcggatctgatgcgcccatcctcgaatacgctcgattgcgcgcgcgggtgtccgagctggaacgtgcgcaggcccgcgcgtcgcggttacagcgacggcaggcggccaccgatgcgctggccgcgctgcgccgcggtgacatcatcaccatcacccacggccgccgcggtggtctggccgtcgtcctggaatcagcccgcgaccgcgacgacccgcgtccgctggtgctaaccgaacaccgatgggcgggacggatctcctcggccgactactcgggcacgacgccggtggggtcgatgacgctgcccaagcgggtggagcaccgccagccgcgggtccggcgtgacctggcctcggcgctgcgatcggcagccgcgggtctggttattccagccgcccggcgcgtcagcgaggccggcgggtttcacgatccggagctggagtcgtcgcgcgaacaattgcgccgtcatccggtgcatacctcgcccgggctcgaggaccagatccgccaggccgagcgttacttacgcatcgaacgcgacaacgcgcaattagagaggaaggtcgccgccgccaccaactcgttggcccgcacgttcgaccgattcgtcgggctgctcaccgaacgggagttcatcgatggcccggccactgatcccgtggtcaccgacgacggccggctgctggcgcggatttacagcgagagcgacctgttggtggccgagtgcctacgtacaggtgcgtgggagggtttaaagccggccgaattggcgggggtggtgtcggcggtggtctacgagacgcgcggtggtgacggccagggcgccccgttcggagccgatgtgcccacaccgcggttacggcaggctctgactcagacatcaaggctgtccacgacattgcgcgccgacgagcaggcacaccgcatcaccccgagtcgcgaacccgacgatggctttgtcagagtcatctaccgctggtcgcgaaccggtgatctagcggcggcattggccgctgccgacgtgaacggcagcggatcaccgttattggcaggggatttcgtgcgttggtgccgtcaggtgctcgatctgctggaccaagttcgtaacgctgcgcccaaccccgaactgcgggctaccgcaaagcgcgctatcggtgacattcggcgcggcgtcgtcgcggttgacgccgggtag

SEQ ID NO: 68 - DNA, 3042 bp, Mycobacterium tuberculosis
atgctggttttgcacggcttctggtccaactccggcgggatgcggctgtgggcggaggactccgatctgctggtgaagagcccgagtcaggcgctgcgctccgcgcggccacacccgttcgcggcgcccgctgacctgatcgccggcatacatccgggcaaacccgcaaccgccgttttgctgttgccgtcgttgcgatcggcgccgctggactcgccggagctgatccggctcgccccgcgcccggccgcgcgaaccgatccgatgctgttggcgtggacggtaccggtggtggacctggaccccaccgcggcgttggccgccttcgaccagcccgcccccgacgtccgctacggcgcgtccgtcgactacctggccgagctggccgttttcgcgcgcgagttggtcgagcgtggtcgcgtgctgccccagctgcgccgcgacacccacggcgcggccgcctgctggcgtccggtgttgcagggacgcgacgtggtcgcgatgacctcgctggtctcggcgatgccgccggtctgccgcgccgaagttggtgggcacgacccgcacgaactggcaacctcggctctggacgcgatggtcgacgccgccgtgcgcgcggcgctgtcaccgatggacctgctgcccccgcgacggggtcgctccaaacggcatcgggccgtggaggcttggctgaccgcgttgacctgcccggacggccggttcgacgcggagcccgacgaactcgacgcgctggccgaggcgttgcggccatgggacgacgtcggtatcggcaccgtcggcccggcgcgggcgacgtttcggctgtccgaagtcgagaccgaaaacgaggagacgcccgcgggctcgttgtggaggctggagttcttattgcagtcgacgcaggaccccagcctgctggtccccgccgagcaggcatggaacgacgacggcagcctgcgccgctggctggaccggccgcaggagctgctgctgaccgaactgggccgggcctctcggattttccccgagctcgtcccggcgctgcgcaccgcgtgcccgtccgggcttgagctcgacgccgacggcgcctaccgattcctgtcgggtacggccgcggtgctcgacgaggctgggtttggcgtgctgctgccgtcctggtgggaccgccgccgcaagctgggcttggtcctgtccgcatataccccggtcgacggcgtggtgggcaaggccagcaagttcggccgcgagcagctcgtcgagttccgctgggagctggccgtgggcgacgatccgctcagcgaggaggagatcgcggcgctgaccgaaaccaagtccccgctgatccggctgcgtggccagtgggtcgcgctcgataccgaacagatgcgccgcgggctggagtttttggagcgtaagccaaccggccgcaagaccaccgccgagatcctcgcgctggccgccagccaccccgacgacgtggacaccccgctcgaggtcaccgccgtacgcgccgacggctggctcggggacctgctcgccggggccgccgcggcgtcgctgcagccgttggacccgcccgacggattcaccgcgacgctgcgtccctaccagcagcgcggtctggcgtggctggcgtttttgtcctcgctcggtttgggcagctgcctggccgacgacatgggcctgggcaagacggtgcagctattggccctggaaaccttggaatccgttcagcgccaccaggatcgcggcgtcggacccacactgctactgtgcccgatgtcgttggtgggcaactggccgcaggaagcggccaggtttgcacccaacctgcgggtgtacgcccaccacgggggcgcccggctgcacggcgaggcgttgcgcgaccacctcgagcgcaccgacctggtcgtgagcacctataccaccgccacccgcgacatcgacgagctggcggaatacgaatggaaccgggtggtgctggacgaggcccaggcggtgaagaacagcctgtcccgggcggccaaggcggtgcgacggctacgcgcggcgcaccgggtcgcgctgaccgggacaccgatggagaaccggctcgccgagctgtggtcgatcatggacttcctcaacccgggcctgctcggatcctccgaacgcttccgcacccgctacgcgatcccgatcgagcggcacgggcacaccgaaccggccgaacggctgcgcgcatcgacgcggccctacatcctgcgccggctcaagaccgacccggcgatcatcgacgatctgccggagaagatcgagatcaagcagtactgccaactcaccaccgagcaggcgtcgctgtatcaggccgtcgtcgccgacatgatggaaaagatcgaaaacaccgaagggatcgagcggcgcggcaacgtgctggccgcgatggccaagctcaaacaggtgtgcaaccaccccgcccagctgctgcacgatcgctccccggtcggtcggcggtccgggaaggtgatccggctcgaggagatcctggaagagatcctggccgagggcgaccgggtgctgtgttttacccagttcaccgagttcgccgagctgctggtgccgcacctggccgcacgcttcggccgtgccgcccgagacattgcctacctgcacggtggcaccccgaggaagcggcgtgacgagatggtggcccggttccagtccggtgacggcccgcccatttttctgctgtcgttgaaggcgggcggtaccgggctgaacctcaccgccgccaatcatgttgtgcacctggaccgctggtggaacccggcggtcgagaaccaggcgacggaccgggcgtttcggatcgggcagcggcgcacggtgcaggtccgcaagttcatctgcaccggcaccctcgaggagaagatcgacgaaatgatcgaggagaaaaaggcgctggccgacttggtggtcaccgacggcgaaggctggctgaccgaactgtccacccgcgatctgcgcgaggtgttcgcgctgtccgaaggcgccgtcggtgagtag

SEQ ID NO: 69 - DNA, 876 bp, Mycobacterium tuberculosis
gtgacctggccgttgcccgatcgcctgtccattaattcactctctggaacacccgctgtagacctatcttctttcactgacttcctgcgccgccaggcgccggagttgctgccggcaagcatcagcggcggtgcgccactcgcaggcggcgatgcgcaactgccgcacggcaccaccattgtcgcgctgaaataccccggcggtgttgtcatggcgggtgaccggcgttcgacgcagggcaacatgatttctgggcgtgatgtgcgcaaggtgtatatcaccgatgactacaccgctaccggcatcgctggcacggctgcggtcgcggttgagtttgcccggctgtatgccgtggaacttgagcactacgagaagctcgagggtgtgccgctgacgtttgccggcaaaatcaaccggctggcgattatggtgcgtggcaatctggcggccgcgatgcagggtctgctggcgttgccgttgctggcgggctacgacattcatgcgtctgacccgcagagcgcgggtcgtatcgtttcgttcgacgccgccggcggttggaacatcgaggaagagggctatcaggcggtgggctcgggttcgctgttcgcgaagtcgtcgatgaagaagttgtattcgcaggttaccgacggtgattcggggctgcgggtggcggtcgaggcgctctacgacgccgccgacgacgactccgccaccggcggtccggacctggtgcggggcatctttccgacggcggtgatcatcgacgccgacggggcggttgacgtgccggagagccggattgccgaattggcccgcgcgatcatcgaaagccgttcgggtgcggatactttcggctccgatggcggtgagaagtga

SEQ ID NO: 70 - DNA, 843 bp, Mycobacterium tuberculosis
gtgtcagcaaccggcccattcagcatcggcgaacgtgttcagctcaccgacgctaaggggcgccgctacaccatgtcgctgactcccggtgccgaattccacactcatcgtggctcgatcgcccacgacgcggtgatcgggttggagcaaggcagcgtggtcaaatccagcaacggcgccctgttcctggtgctgcgcccgctgctggtcgactacgtcatgtcgatgccgcgcggcccgcaggtgatctatcccaaagatgcggcccagatcgtgcatgagggcgacatatttcccggcgcgcgggtgctggaggcaggagccggatccggtgctctgaccttgtctttgctgcgggcggttgggccggccggacaggtgatctcctacgaacagcgcgccgatcatgccgaacacgcccggcgcaatgtgagcggctgctacggccagccgccggacaactggcgactggtcgtcagcgacctcgccgactccgaactgcccgacggatccgttgatcgggccgtgctcgacatgctggcgccgtgggaggtgctcgacgcggtatcgcggctgctggtcgccggcggagtgctgatggtctacgtggccaccgtcactcagctgtcgaggatcgtggaggcactgcgggccaagcagtgctggaccgaaccgagagcctgggagacgctgcagcggggctggaacgtcgtagggttggcggttcggccgcagcattcgatgcgcgggcataccgcgttcctggtagcaacgcgccggttggcgccgggggctgtggctccggcgccgctaggtcgtaagcgcgagggacgcgacgggtag

SEQ ID NO: 71 - DNA, 357 bp, Mycobacterium tuberculosis
atgctgatcattgcgctggtcttggccctgattgggctcctggccttggtgttcgcggtggtcaccagcaaccagctagtggcctgggtatgcatcggggccagcgtgctgggtgtggcgttgctgatcgtcgatgcgttgcgagaacgccagcaaggtggcgcggacgaagctgatggggctggggaaacgggtgtcgcggaggaagccgacgtcgactacccggaggaagcccccgaggagagccaagccgtcgacgccggtgtcatcggcagtgaggagccatcggaggaggccagcgaagcgaccgaggagtcggcggtatcggcggaccgaagcgacgacagcgccaagtag

SEQ ID NO: 72 - DNA, 291 bp, Mycobacterium tuberculosis
ttggtggtgttttttcagatccttgggttcgcgctgttcatcttctggctgctgctgatcgctcgggtcgtcgttgagttcatccgctcgttcagccgtgactggcgtcccaccggtgtcaccgtggtgatcttggagatcatcatgtcgatcactgatccgccggtgaaggtgctgcgccggctgatcccgcaactcacgatcggcgcggtccggttcgacctgtcgatcatggtgctgctgctggttgcgttcatcggtatgcaactggcgtttggtgctgcggcctga

SEQ ID NO: 73 - DNA, 726 bp, Mycobacterium tuberculosis
gtgaatagtcactgtagtcacaccttcatcacagacaacagatctcccagggctagaaggggtcacgcaatgagcacactgcacaaggtcaaggcctacttcggtatggctcccatggaggattacgacgacgagtactacgacgaccgcgctccctcgcgcgggtatgcgcggccccgattcgacgacgactacggccgctacgatgggcgcgactacgacgacgcgcgcagcgattcacgcggtgacctgcgcggtgagccggccgactatccaccaccgggatatcgcggcgggtacgcggacgaaccacgtttccggccccgggagttcgaccgcgcggagatgacacggccgcgcttcggatcgtggctgcgcaactccacccgcggcgcgctagcgatggacccccgccggatggcgatgatgttcgaggatggccatccgctctcgaagatcaccacgctgcggcccaaggactacagcgaggctcgcaccatcggtgagcggttccgcgacggcagcccggtcatcatggatctggtgtcgatggacaacgccgatgccaagcggctggtcgatttcgcggccggcctggccttcgcgctgcgcggctcgttcgacaaggtcgcgaccaaggtgttcctgctctcgcctgcagacgtcgatgtgtcccccgaggagcgccgcaggatcgccgaaaccgggttctacgcctaccaatag

SEQ ID NO: 74 - DNA, 777 bp, Mycobacterium tuberculosis
atggcggcggatctttcggcgtatccagaccgcgaatcggaattgacgcatgcgttggcggcaatgcgatcgcgacttgcggcggccgcggaggcggcgggtcgcaatgtcggcgaaattgaacttctaccgattaccaaattctttccagcaaccgatgttgcgattttgtttcgattgggttgtcggtccgttggcgaatcgcgcgaacaggaagcttcagccaagatggccgaacttaatcggttgttggcggctgccgagttgggtcactcggggggtgtgcactggcacatggtgggccggattcaacgcaacaaagccgggtcgctggctcgctgggcgcacaccgctcactcggtggacagctcgcggttggtgaccgcgctggatcgggcggttgttgcggcgctggccgaacaccgtcgtggcgagcggctgcgggtttacgtccaggtcagcctcgacggtgacggatcccggggcggcgtcgacagcacgacgcccggcgccgtagaccggatttgcgcgcaggtgcaggagtcagagggcctcgaactggtcgggttgatgggcattccgccgctggattgggacccggacgaggcctttgaccggctgcaatcggagcacaaccgggtgcgtgcgatgttcccgcacgcgatcggtctgtcggcgggcatgtccaacgaccttgaagtcgccgtcaaacatggttcgacctgtgtgcgtgtcggtaccgcgctattgggtccgcggcggttacggtcaccgtga

SEQ ID NO: 75 - DNA, 1140 bp, Mycobacterium tuberculosis
atgacccccccgcacaactacctggccgtcatcaaggtcgtgggtatcggtggtggcggtgtcaacgccgtcaaccgaatgatcgagcagggcctcaaaggcgtggaattcatcgcgatcaacaccgacgcccaggcgttgttgatgagcgatgccgacgtcaaactcgacgtcggccgcgactccacccgcgggctgggcgccggcgccgatccggaggtcggccgtaaggccgccgaggacgccaaggacgagatcgaagagctgctgcgcggtgccgacatggtgtttgtcaccgccggcgaggggggcggaaccggcaccgggggggcacccgtcgtcgccagcatcgcccgcaagctgggcgcgttgaccgtcggtgtggtcacccggccgttctcgttcgagggcaagcgacgcagcaatcaggccgaaaatggcatcgcggcgctgcgggagagttgcgacaccctcatcgtgattcccaacgaccggttgctgcagatgggagatgccgcggtatcgctgatggatgctttccgtagcgccgacgaggtgctgctcaacggcgtgcagggcatcaccgacctgattaccaccccgggtctaatcaacgtcgacttcgccgacgtcaagggcatcatgtccggtgccggcaccgcactgatgggcatcggctcggcccggggcgaaggccggtcgctcaaagcggccgagatcgccatcaactcgccgttgctggaagcctcgatggagggcgcgcaaggcgtgctgatgtcgatcgccggcggcagcgacttgggcttgttcgagatcaacgaggcggcctcgttggtacaagacgccgctcaccccgatgccaacatcatcttcggcaccgtcatcgacgattcgctcggtgacgaggtgcgggtgaccgtgatcgcggccggcttcgacgtcagcggtcccggccgcaagccggtgatgggcgagaccggcggcgcccaccggatcgagtcagccaaggcaggcaagctcacctcgaccttgttcgagccggtcgacgccgtcagcgtgccgttgcacaccaacggcgcaaccctgagcatcggcggtgatgacgacgatgtcgacgtgccgcccttcatgcgccgctga

SEQ ID NO: 76 - DNA, 1485 bp, Mycobacterium tuberculosis
gtgagcaccgagcagttgccgcccgatctgcggcgggtgcacatggtcggcatcggcggagctggcatgtcgggcatcgcccgaatcctgctggaccgcggcgggctggtctccgggtcagacgccaaggagtcgcgcggtgtgcatgcgctgcgggcgcggggcgcgttgatccggatcggacacgacgcgtcgtcgctggacctgttgcccggtggcgccacggcggtcgtcactacccatgccgccatccccaaaaccaaccccgagctcgtcgaagcgaggcgccgcggcattcccgtggtgctgcggccggccgtgctggccaagttgatggccgggcgcaccacattgatggtcaccggcacgcacggcaagacaacgacgacgtccatgctgatcgtcgccctgcagcactgcgggcttgacccgtcctttgcggtcggcggtgagctgggggaggccggtaccaacgcccatcacggcagtggcgactgtttcgtcgccgaagccgacgaaagcgatggctcgctgttgcagtacacaccccacgtcgcggtgatcaccaacatcgagtccgatcacctggacttctacggcagcgtcgaggcgtatgttgcggtgttcgactccttcgtggagcgcattgtccccgggggtgcgctggtggtgtgcactgacgaccccggaggggccgcgctggctcagcgcgcgactgagctgggaattcgagtgctgcgatacgggtcggtgccgggtgagaccatggcagccacgttggtctcgtggcagcaacagggggtcggcgcggtcgcacatatccggttggcctcagaactagccacagcacagggtccccgcgtgatgcggctgtcggtgcccgggcgacacatggcgctcaacgcgctgggagcgctgctggccgcggtgcagatcggcgccccggccgacgaggtgctcgacgggctggccggcttcgaaggagtgcggcgacgattcgaactggttgggacctgcggcgtcggaaaggcgtcggtgcgcgtgttcgatgactacgcccaccacccgacggagatcagcgcgacactggcggcggcgcgcatggtgctcgaacagggcgacggtggccgctgcatggttgtgtttcaaccccatttgtattcgcggacaaaggcattcgctgctgagtttgggcgtgcgctgaatgccgctgacgaggtgttcgtactcgacgtctacggagctcgtgaacaaccgctggccggtgtcagcggagccagcgtcgctgagcacgtcactgtgccgatgcgctacgtcccggatttttcggcggtcgcacagcaagtggccgccgccgctagtccgggcgacgtcatcgtcacgatgggtgccggagacgtgaccttgctgggcccggaaatcctgaccgcccttcgggtccgggccaaccgaagcgcccccggccgtccgggggtgctgggatga

SEQ ID NO: 77 - DNA, 1233 bp, Mycobacterium tuberculosis
gtgaaggacacggtcagccagccggccggcgggcgcggggcaacggcgccccggcccgccgatgccgcctcgccgtcttgtggttcctcgccgtctgctgattccgtgtcggtcgttctcgccggcggcgggaccgccgggcacgtcgagcccgccatggccgtcgccgacgccttggtcgcgttggatccgcgcgtccggattaccgcgttgggcaccctccgtggactagagaccaggctggtgccccagcgcggctaccacctggagctgatcacggcggtgccgatgccgcgcaagcccggcggcgacctggcccggctgccgtcgcgggtgtggcgcgccgtccgggaggcccgggacgtgctcgacgatgtcgacgccgacgtcgtcgtcggtttcggtgggtacgtcgcgctaccggcttacctagccgctcgcggcctgcctttgccgccccggcgccggcgccggatcccggtggtgatccacgaagccaacgccagggcgggactggccaaccgggtcggcgcccataccgcggaccgggtgctctccgcggtgccggattccgggctgcggcgcgccgaggtggttggggtcccggtccgtgcgtcgatcgccgcgctggaccgcgcggtgctgcgagccgaggcgcgggcacacttcggcttccccgacgacgcgcgggtgctgctggtgttcgggggttcgcagggcgcggtctcgctcaaccgggcggtgtccggcgccgccgccgacctggccgccgccggtgtttgcgtgctgcatgcccatggaccccagaacgtgctggagttgcgccgtcgggctcaaggtgacccaccgtacgtggcggtgccctatttggaccggatggagctggcctacgccgccgccgatctggtgatctgccgggccggggcgatgacggtcgccgaagtatccgccgtcggtctgccggccatctacgtgccgctgccgatcggcaacggtgaacagcggctgaatgcgttgccggtagtcaatgccggcggcggcatggtggtcgccgacgccgccctgacccccgagttggtggcccgccaggttgccgggctgctcaccgaccccgcgcggctggccgcgatgaccgcggccgcagccagggtgggacatcgcgatgccgcgggccaggtggcccgggccgcgctggccgtcgccaccggggccggtgccaggacaacgacgtga

SEQ ID NO: 78 - DNA, 1575 bp, Mycobacterium tuberculosis
gtgctaacccggttgctgcgtcggggcaccagcgacaccgacggctcccagactcgaggggccgagccggtcgaggggcagcggacgggcccggaagaagcctctaacccgggttcggcgaggccccgcacccgtttcggtgcctggctgggccgtccgatgacctcgtttcacctcatcatcgccgttgccgcattgctgaccacccttggactgatcatggtgctgtcggcatcggcggtgcggtcctacgacgacgacggatcggcttgggtgatcttcggcaagcaggtcttgtggacgcttgtgggtcttatcggcggctatgtctgtctgcggatgtcggtgcggttcatgcggcgcatcgccttctccggtttcgcgatcaccatcgtgatgctggtgctggtgctggtgccggggatcggcaaggaggccaacggctcgcgcggctggttcgtggtcgcgggcttctcgatgcagccctctgagctggctaagatggcgttcgccatctggggagcgcatctgctggccgcccggcgcatggaacgggcttcactgcgcgagatgctgattccactggtgccggccgccgtcgttgcgctggcgctgatcgtggcccagcccgacctcggacagaccgtgtcgatgggcatcatcttgttgggcctgctgtggtatgcggggctgccgctgcgcgtcttcctcagctcactggcggcggtcgtcgtctcggccgccatcctggcggtgtccgcgggctaccgatccgaccgggtgcggtcgtggctcaaccccgaaaacgatccgcaagactccggctaccaggcccgacaggcaaagttcgcgctggctcaaggtggcattttcggcgacggtctgggccaaggcgtggccaagtggaactacttgcccaacgcccacaacgacttcattttcgccatcatcggcgaagagctgggtctcgtcggcgcgctcggactgctggggctattcggattgttcgcctacaccggcatgcgcatcgctagccggtccgccgacccgttcctgcggctgctgaccgccaccacgacactgtgggtgctgggacaggcgttcatcaacatcggctatgtgatcgggctgctgcccgtcaccggcctgcagctgccgctcatctccgccggtggaacctccacggccgcaacactttcgctgataggcatcatcgccaacgcggctcgccacgaaccggaggcggtggccgcgctgcgggctgggcgcgacgacaaggtgaaccggttgctgcggctgccgctgcccgagccgtatctgccccctcgtctcgaggcgtttcgtgaccgcaagcgcgccaacccgcaaccggcccaaacgcagcccgcgcggaagaccccccgcacggcgcccggacagcctgcccggcagatgggcctgcccccgcgacccggctcgccccgcacggccgatccgccggttcgtcgatcagtgcatcatggagctggccagcggtacgcgggccagcgtcgcacacggcgcgttcgggcattggaaggtcagcgttacgggtga

SEQ ID NO: 79 - DNA, 1461 bp, Mycobacterium tuberculosis
gtgcttgaccctctggggccgggtgcgcccgtgttggtagccggtggccgggtgaccggtcaggcggtggccgcggtgctgactcggtttggtgcgacgccgacggtgtgcgacgacgatccggtcatgctgcgaccgcacgccgaacgtgggctgccgaccgttagttcctcggacgcggtgcagcagataaccgggtatgcgctggtggtcgccagtcccggcttctcgcccgcaaccccgctactggccgcggccgcggcggcgggggtgccgatctggggtgacgtggagttagcctggcggctagacgcagcgggctgctacggaccgccgcgcagctggctggtggtgaccggcaccaacggcaagaccaccacgacgtcgatgctgcacgccatgctgatcgccggtggccgccgcgccgtgctgtgcggcaatatcggcagtgcggtgctggatgtgctggacgagccggccgagctgctggccgtggagttgtccagtttccagctgcactgggcgccgtcgctgcggcccgaggccggcgcggtgctcaacattgccgaagaccacctggactggcatgccacgatggccgaatacaccgcggccaaggcccgggtgctgaccggcggggtagcggtggccgggctggatgacagccgagcggccgcactgctggacggctcaccggcgcaggtgcgggtcggcttccggctcggcgagccggccgcgcgggaactgggcgtgcgcgacgcccacctggtcgatcgcgccttctccgacgacttgacgctgctgccggtcgcgtcgataccggtgccaggtccggtcggcgtgcttgacgccctggccgcggcggcgctggcccgctcggtcggggtgcccgccggtgcgatcgccgacgcggtcacgtcgtttcgagtgggccgacaccgcgccgaggtggtggccgttgccgacggcatcacctacgtggacgactccaaggccaccaacccgcacgccgcgcgggcttcggtgcttgcatacccgagggtggtatggatcgccggtggcctgctcaagggcgcgtcgcttcacgccgaggttgcggcgatggcgtcgcggctggtcggtgcggtgctgatcggccgggatcgcgcagcggttgccgaggcgttatcacgacacgcgcccgatgtcccagtcgttcaggttgtggcaggcgaggatactggtatgcctgcgactgttgaggttcctgttgcttgtgttctagatgtggcaaaagatgacaaagccggtgagaccgttggcgctgccgtgatgaccgctgcggtggccgcggcccggcggatggcccaacccggtgacaccgtgctgctggcaccggccggcgcctcattcgaccagttcaccggttatgccgaccggggcgaggcattcgcgaccgcggtccgcgcggtgatccggtag

SEQ ID NO: 80 - DNA, 1080 bp, Mycobacterium tuberculosis
atgaggcagatccttatcgccgttgccgtagcggtgacggtgtccatcttgctgaccccggtgctgatccggttgttcactaagcagggcttcggccaccagatccgtgaggatggcccgcccagccaccacaccaagcgcggtacgccgtcgatgggcggggtggcgattctggccggcatctgggcgggctacctgggcgcccacctagcgggcctggcgtttgacggtgaaggcatcggcgcatcgggtctgttggtgctgggcctagccaccgctttgggcggcgtcgggttcatcgacgatctgatcaagatccgcaggtcgcgcaatctcgggttgaacaagacggccaagaccgtcgggcagatcacctccgccgtgctgtttggcgtgctggtgctgcagttccggaatgctgccggcctgacaccgggcagcgcggatctgtcctacgtgcgtgagatcgccaccgtcacattggcgccggtgctgttcgtgttgttctgcgtggtcatcgtcagcgcctggtcgaacgcggtcaacttcaccgatggcctggacgggctggccgccggcaccatggcgatggtcaccgccgcctacgtgctgatcaccttctggcagtaccgcaacgcgtgcgtgacggcgccgggcctgggctgctacaacgtgcgcgacccgctggacctggcgctcatcgcggccgcaaccgctggcgcctgcatcggttttttgtggtggaacgccgcgcccgccaagatcttcatgggtgacactgggtcgctggcgttgggcggcgtcatcgcggggttgtcggtgaccagccgcaccgagatccttgcggtggtgctgggtgcgctgttcgtcgccgagatcacctcggtggtgttgcaaatcctgaccttccggaccaccgggcgccggatgtttcggatggcgcccttccaccaccatttcgagttggtcggttgggctgaaaccacggtcatcatccggttctggctgctcaccgcgatcacctgcggtctgggcgtggccttgttctacggtgagtggcttgccgcggtcggtgcctga

SEQ ID NO: 81 - DNA, 1533 bp, Mycobacterium tuberculosis
atgatcgagctgaccgtcgcgcagatcgccgagatcgtcgggggcgcagtggccgatatctccccgcaagacgccgcgcaccgccgcgtcaccgggaccgtcgagttcgactcgcgcgccatcggcccgggcgggctgttcctcgccctgccgggggcgcgcgccgacggccacgaccatgccgcgtcggcggtagccgcgggcgccgccgtcgtgctggccgcccgcccggtgggggtgccggccatcgtggttccgccagtggccgcgccgaacgtattggccggcgtcctcgagcacgacaacgacgggtcgggggcggcggtgctggccgcgctggccaagctggccaccgcggtggccgcgcagttggtggccggcgggctcaccatcatcgggatcaccggctcgtcgggcaagacgtcgaccaaggacctgatggccgccgtgctggccccgctgggggaggtggtggccccgcccggatcgttcaacaacgagctgggtcacccgtggacggtgctgcgcgcgacgcggcgcaccgactacctgattttggagatggcggcacgccatcacggcaacatcgccgcgctcgccgagatcgcgcccccgtcgatcggagtcgtgctcaacgtcggcaccgcacatttgggtgagttcggctcccgcgaggtcatcgcacagaccaaagccgaactgccgcaggctgttccgcattccggagcggtcgtcctcaacgctgatgaccccgcggtggcggcgatggccaagctgaccgcggcccgggtggtgcgggtcagccgggacaacaccggtgacgtttgggcggggccggtgtcgctggacgaattggccaggccgcgctttacgctgcatgcccacgatgcccaagccgaggtccgactcggggtctgcggcgaccaccaggtcactaacgcgctgtgcgccgcggcggtcgcgctggagtgtggggccagcgttgaacaggtcgcggccgcgctgaccgcggcgccgccggtgtcgcggcatcggatgcaggtgaccacccgcggcgacggggtgacggtgatcgacgacgcctacaacgccaaccccgactccatgcgggccgggctgcaggcgctggcctggatcgcgcaccaacccgaggccacccgccgcagctgggcggtgctgggtgagatggccgagctgggtgaggacgcgatagccgagcacgatcgcatcggccggctcgcggtgcgcttagatgtgtctcgactcgttgtcgtgggaaccgggaggtcgatcagcgccatgcaccacggagcggtcctggagggggcgtggggctcgggggaagccactgctgatcacggtgcggatcgcacggccgtcaatgtggccgacggtgacgccgccctggcactactgcgcgccgagctgcgacccggggatgtggtcttggtcaaggcctcgaacgcggccgggctgggtgcggtggccgatgcattggtcgcagacgacacatgcgggagtgtgcgcccatga

SEQ ID NO: 82 - DNA, 1608 bp, Mycobacterium tuberculosis
gtgtcatcgctggcccgagggatctcgcggcggcgaacggaggtggcgacacaggtggaggctgcgcccactggcttgcgccccaacgccgtcgtgggcgttcggttggccgcactggccgatcaggtcggcgcggccctggccgagggtccagctcagcgtgccgtcaccgaggaccggacggtcaccggggtcacgctgcgcgcccaggacgtgtcacccggtgacctgttcgccgccctgaccggctcgaccacccacggggcccgccacgtcggcgacgcgatcgcacgcggcgccgtcgcggtgctcaccgaccccgccggggtcgccgagatcgccggacgagcggccgtgcccgtgttggtgcaccccgcaccccgcggcgtgctcggcggcttggccgccaccgtgtacgggcatccgtccgagcggttgacggttatcgggatcaccggaacgtccggcaagaccaccaccacctatctggtcgaggccgggttacgggctgccggacgcgtcgccgggctgatcggcaccatcggcatccgcgtcggcggcgccgaccttcccagcgcgctgaccaccccggaggcccccacgctgcaggcgatgctggcggcgatggtcgaacgcggggtggacaccgtggtcatggaggtgtccagccacgcgctggcgctgggccgggtggacggcacccggttcgccgtcggcgccttcaccaatctctcccgtgaccacctggatttccaccccagcatggccgactacttcgaggccaaggcgtcattgttcgatccggactcggcactgcgcgcccgcaccgccgtggtgtgcatcgacgacgacgccgggcgcgcgatggcggcgcgggccgccgacgcgatcaccgtcagcgccgccgaccggcccgcacactggcgcgccacggatgtggcgcccacggacgcgggcgggcaacaattcaccgccatcgaccccgccggcgtagggcatcacatcggaatccggctaccgggccgctacaacgtcgccaattgcctggtcgccctggcgattctggacaccgtcggggtctccccggaacaggcggtgccgggcctgcgtgagatccgggtcccggggcggctcgagcagatcgaccgcggccagggctttctcgcgctggtcgactacgcgcacaaaccggaagcgctgcggtcggtgctgaccaccttggcgcacccggaccgccggctggcggtggtgttcggcgccggcggcgatcgtgacccgggcaagcgggccccgatgggccggatagccgcgcagctggccgacttggtggtcgtcaccgacgacaacccgcgtgacgaagatcccacggcgatccgccgcgaaatcctggctggggcggccgaagtcggcggtgatgcccaggtcgtcgagatcgcagaccggcgggacgcgatccggcacgcggttgcctgggcgcgccccggcgacgtggtgctcatcgccggcaaaggccacgagaccgggcaacgcggcggcgggcgggtccgcccgttcgacgaccgggtggagctggctgccgcgctagaggccctcgagcggcgcgcatga

SEQ ID NO: 83 - DNA, 1035 bp, Mycobacterium tuberculosis
atgaaatttgtcaaccatattgagcccgtcgcgccccgccgagccggcggcgcggtcgccgaggtctatgccgaggcccgccgcgagttcggccggctgcccgagccgctcgccatgctgtccccggacgagggactgctcaccgccggctgggcgacgttgcgcgagacactgctggtgggccaggtgccgcgtggccgcaaggaagccgtcgccgccgccgtcgcggccagcctgcgctgcccctggtgcgtcgacgcacacaccaccatgctgtacgcggcaggccaaaccgacaccgccgcggcgatcttggccggcacagcacctgccgccggtgacccgaacgcgccgtatgtggcgtgggcggcaggaaccgggacaccggcgggaccgccggcaccgttcggcccggatgtcgccgccgaatacctgggcaccgcggtgcaattccacttcatcgcacgcctggtcctggtgctgctggacgaaaccttcctgccggggggcccgcgcgcccaacagctcatgcgccgcgccggtggactggtgttcgcccgcaaggtgcgcgcggagcatcggccgggccgctccacccgccggctcgagccgcgaacgctgcccgacgatctggcatgggcaacaccgtccgagcccatagcaaccgcgttcgccgcgctcagccaccacctggacaccgcgccgcacctgccgccaccgactcgtcaggtggtcaggcgggtcgtggggtcgtggcacggcgagccaatgccgatgagcagtcgctggacgaacgagcacaccgccgagctgcccgccgacctgcacgcgcccacccgtcttgccctgctgaccggcctggccccgcatcaggtgaccgacgacgacgtcgccgcggcccgatccctgctcgacaccgatgcggcgctggttggcgccctggcctgggccgccttcaccgccgcgcggcgcatcggcacctggatcggcgccgccgccgagggccaggtgtcgcggcaaaacccgactgggtga

SEQ ID NO: 84 - DNA, 2040 bp, Mycobacterium tuberculosis
gtgagccgcgccgcccccaggcgggccagtcagtcgcagtcgacgcgaccggcgcgcggtttgcgccggccaccgggagcccaggaggttgggcaacgcaaacggcccggcaaaacgcagaaagcccggcaagcccaggaagccacgaaatcccgccctgcgacacggtcagacgtcgcacccgcgggtcgctcgactcgtgcgaggcgcacccggcaggtggtggacgtcgggacgcgcggtgcgtcgttcgtctttcggcatcggaccggaaacgcggtcatcttggtgttgatgttggtcgcggcaacacaattgttctttctgcaggtatcacatgccgcgggcctgcgtgcgcaggcggccggccaactcaaggtcaccgacgtccagccagcggctcgcggcagcatcgtcgaccgcaacaatgaccggctcgcgttcaccatcgaggcgcgtgccctgacgttccagccgaagcggattcggcggcaattggaagaggccaggaagaagacgtcggctgcacccgacccgcagcagcgcctgcgcgatatcgcccaggaggtcgccggcaagctgaacaacaagccagatgccgcggccgtgctgaagaagctgcaaagcgacgagaccttcgtctacttggcgcgtgcggtcgacccggctgtcgccagcgcgatctgcgcgaagtatcccgaggtcggtgcggaaagacaggatctgcgtcagtacccgggtgggtcgctggcggcaaacgtcgtcggtggcatcgactgggatggtcatgggctgctgggtctggaggactccctggatgcggtgctggccggaaccgacggatcggtcacctacgaccgtgggtcagacggcgtcgtcatccccggcagctaccggaatcggcacaaggcggtccacggttccaccgtcgtgctcaccctcgacaacgacatccagttctacgtgcagcagcaggtgcagcaggccaagaacctatcgggggctcacaacgtctcggccgtcgtcctggacgccaagaccggcgaggtgctcgcgatggccaacgacaacaccttcgacccgtcgcaagacatcgggcgccagggcgacaagcagttgggcaacccggcggtgtcgtcgcccttcgagccgggctcggtgaacaagatcgtcgccgcgtccgcggtcatcgagcacgggttgagcagccccgacgaggtgctacaggtgcctggctcgatccagatgggcggtgttaccgtgcatgacgcttgggagcacggcgtgatgccctataccaccacgggggtgttcggaaagtcctccaacgtcggcacgctgatgctttcccaacgtgtcggaccggaacgctattacgatatgctccgcaagttcgggttgggacagcgcaccggcgtgggcctgcccggtgagagcgccggactggtgccgccaatcgaccagtggtcgggcagtacgttcgctaatcttcctattggccaaggtctttcgatgactttgctgcagatgaccggcatgtaccaggccatcgccaacgatggagtgcgggtacccccacgcattatcaaggccaccgtcgcacccgacggcagccgaaccgaagaaccgcgccccgacgacattcgcgtggtgtcggcgcagaccgcccagaccgtgcgccagatgctgcgtgccgtggtgcaacgcgatccgatgggctaccagcagggtaccgggccgacggccggggtgcccggctatcagatggccggcaagaccggtaccgcgcagcagatcaaccctggctgcggctgctacttcgacgacgtgtattggatcaccttcgccggaatcgccactgccgacaatccccgctacgtgatcggcatcatgttggacaacccggcgcgcaactccgacggcgcgcctgggcactcggccgccccgctgttccacaacatcgcgggctggctgatgcagcgcgaaaacgtcccgctgtcacccgatcccgggcctcctttggtcttgcaggccacctag

SEQ ID NO: 85 - DNA, 1191 bp, Mycobacterium tuberculosis
gtgcaaacccgtgcaccgtggtctctgcccgaagcgaccctggcgtacttccccaacgccaggttcgtgtcttcggacagggacctcggtgcaggggcggcgcctggaatagccgcgtcccgaagtacggcttgccagacctggggaggtatcacggtggctgatccaggttcggggccaaccggtttcggtcatgtgccggtattggcgcaacgttgcttcgaactgcttacccccgcactaacccgctactatccagacggctcgcaggcggtccttctcgacgcgaccatcggcgcgggcgggcatgcggagcggtttttggagggattgccgggtctgcgcctgatcgggctcgaccgtgacccaaccgctctggacgtcgcgcggtctcggctggtgcgattcgctgaccgacttaccctggtgcacacccgctatgactgtctgggcgcagcgctggctgaatccggttatgccgcagtgggatcagtcgacggaatcctgttcgatctcggcgtctcatccatgcagctcgaccgcgccgagcggggcttcgcctacgccacggacgcgccattggacatgcggatggacccgacgacgccgttgaccgcagctgacattgtcaacacttacgacgaggcggcactagccgacatcctgcgtcgctacggagaggagcggtttgctcggcgcatcgctgccggtatcgtccgccgacgcgcaaaaaccccgttcacctcgaccgccgaactggttgccctgctgtaccaggcgattccagctccggcccggcgtgtcggcgggcatccagccaagcgaacattccaggcgctgcgcatcgcggtcaacgatgagctggaatcgctgcgcacggccgttcctgccgcgctggatgccctcgctatcggtgggcgcatcgcggtgctggcctaccagtcgctagaggacaggatcgtcaaacgggtgttcgccgaggcagtcgcgtcggccacccctgcgggacttccggtcgaacttcccggccatgagccgcgattccgttcgttaacgcacggcgccgaacgagcgagtgtggctgagatcgaacgcaatccccgcagtactccagtgcggttgcgggccctgcaacgagtcgagcaccgggcgcaatcgcagcaatgggcaaccgagaagggtgattcatga

SEQ ID NO: 86 - DNA, 432 bp, Mycobacterium tuberculosis
atgtttctcggcacctacacgcccaaactcgacgacaaggggcggctgacgctgccggccaagtttcgcgacgcgttggcaggggggttgatggtcaccaagagccaagatcacagcctggccgtttacccgcgggcggcgttcgagcagctggcgcgccgggccagcaaggcgccacgaagcaaccccgaggcgagagcgttcctacgtaatctcgccgccggtaccgacgaacagcatcccgacagtcaaggccggatcaccttgtcggccgaccaccgccgctacgcaagcctttccaaggactgtgtggtgatcggcgcggtcgactatctcgagatctgggatgcgcaagcctggcagaactaccaacaaatccatgaagagaacttctccgcggccagcgatgaagcactcggtgacatcttctga

SEQ ID NO: 87 - DNA, 645 bp, Mycobacterium tuberculosis
atggtgagcagatattccgcataccggcgtgggccggatgtaatctcgccggacgtcatcgatcgcatcctggttggggcatgtgccgcggtgtggctggtgttcaccggcgtgtcggtggccgccgctgtcgccctgatggacctgggtaggggcttccacgagatggccggaaacccgcacaccacgtgggtgctgtacgccgtaattgtggtctccgcactggtcatcgtgggcgcgataccggtgctgttgcgagctcgccgcatggctgaggccgagcccgcgacgaggccgacgggtgcatccgtgcggggcgggcgatcgatcggatccgggcatccggcgaaacgcgctgtggccgagtcggcacccgtacagcacgcggatgcattcgaggtggccgccgagtggtccagtgaggcggtggaccggatctggttgcgcgggacagtcgtgttgaccagtgcgattggcattgcgttgattgccgtggcggcggcgacctacctcatggcggtcggtcacgacgggccatcttggatcagctacgggttggccggggtggtcaccgcgggcatgccggtgatcgagtggctatacgctcggcagctgcgccgggtggtggcgccccagtccagttag

SEQ ID NO: 88 - DNA, 900 bp, Mycobacterium tuberculosis
atgagcgggccgaatcccccgggacgggaacctgacgaacccgaatcggaacccgtcagcgacacgggcgacgaacgggcttccggcaaccacttgccgcccgtcgccgggggcggcgacaaactgcccagtgaccagacgggcgagaccgacgcatattctcgggcatactctgccccggaatccgagcacgtcaccggcggcccgtatgtgccagccgatctcaggctctatgactacgacgactatgaggagtcgtccgacctggacgacgaactggccgctccgcgctggccgtgggtggtcggtgtcgccgccataattgccgccgttgcgctcgtggtttcggtgtcgttgctcgtcacgcgaccacataccagcaaactcgccaccggcgacactacgtcctctgcaccgcccgtgcaggacgaaatcacgaccaccaagccggcgccgccaccgccgccaccagccccaccgcccaccaccgagatcccgacagcgacggagacacagacggtcactgtgacgccgccaccaccgcccccaccggcgacaaccacggcgccgccgccggcgaccaccacaacggcggcggcaccgccgcccacgaccaccacgccgaccggtccgcggcaagtcacctattcggtgaccggtaccaaggcgccgggtgacattatctcggtgacttacgtcgatgccgccgggcgccgacggacacagcacaatgtgtacatcccgtggtccatgacggtcaccccgatctcgcaatccgacgttggctcggtggaggcctccagccttttccgggtcagcaaactcaactgctcgatcaccacgagcgacggaacggtgctctcatcgaactccaacgatggaccgcaaacgagctgctga

SEQ ID NO: 89 - DNA, 420 bp, Mycobacterium tuberculosis
atgcatatcgaagcccgactgtttgagtttgtcgccgcgttcttcgtggtgacggcggtgctgtacggcgtgttgacctcgatgttcgccaccggtggtgtcgagtgggctggcaccactgcgctggcgcttaccggcggcatggcgttgatcgtcgccaccttcttccggtttgtggcccgccggttagattcccggcccgaggactacgaaggcgctgaaatcagcgacggcgcaggagaacttggattcttcagtccgcatagctggtggccgatcatggtcgcgttgtccggctcggtggcagcggtcggcatcgcgttgtggctcccgtggctgatcgccgccggtgtggcattcatcctcgcctcggcggccggattggtcttcgaatattacgtcggtcctgagaagcactga

SEQ ID NO: 90 - DNA, 1092 bp, Mycobacterium tuberculosis
gtgacacctcgcgggccaggtcgtttgcaacgcttgtcgcagtgcaggcctcagcgcggctccggagggcctgcccgtggtcttcgacagctggcgctcgcagcaatgctgggggcattggccgtcaccgtcagtggatgcagctggtcggaagccctgggcatcggttggccggagggcattaccccggaggcacacctcaatcgagaactgtggatcggggcggtgatcgcctccctggcggttggggtaatcgtgtggggtctcatcttctggtccgcggtatttcaccggaagaagaacaccgacactgagttgccccgccagttcggctacaacatgccgctagagctggttctcaccgtcataccgttcctcatcatctcggtgctgttttatttcaccgtcgtggtgcaggagaagatgctgcagatagccaaggatcccgaggtcgtgattgatatcacgtctttccagtggaattggaagtttggctatcaaagggtgaacttcaaagacggcacactgacctatgatggtgccgatccggagcgcaagcgcgccatggtttccaagccagagggcaaggacaagtacggcgaagagctggtcgggccggtgcgcgggctcaacaccgaggaccggacctacctgaatttcgacaaggtcgagacgttgggcaccagcaccgaaattccggtgctggtgctgccgtccggcaagcgtatcgaattccaaatggcctcagccgatgtgatacacgcattctgggtgccggagttcttgttcaagcgtgacgtgatgcctaacccggtggcaaacaactcggtcaacgtcttccagatcgaagaaatcaccaagaccggagcattcgtgggccactgcgccgagatgtgtggcacgtatcactcgatgatgaacttcgaggtccgcgtcgtgacccccaacgatttcaaggcctacctgcagcaacgcatcgacgggaagacaaacgccgaggccctgcgggcgatcaaccagccgccccttgcggtgaccacccacccgtttgatactcgccgcggtgaattggccccgcagcccgtaggttag

SEQ ID NO: 91 - DNA, 1248 bp, Mycobacterium tuberculosis
atgaccgtgccagcaccgtcgcagctcgacttgcgtcaagaggtgcacgacgccgcacgccgcgcccgggtggccgcccgccggctggcatcgctgccgacgactgtcaaagaccgcgcgctgcacgcggctgccgacgagctactggctcaccgcgaccagatcctggcggccaacgccgaagacctgaacgcggcgcgcgaggcggacaccccggccgccatgctggaccggttgtccttgaacccgcaacgagtcgacggtatcgccgccgggttgcggcaagtcgcgggactgcgcgatccggtcggtgaagtgctgcgtggctataccctgcccaacgggctgcagctgcgccagcagcgcgtccccctgggcgtggtcggcatgatctacgagggccgccccaatgtcaccgtggatgccttcgggctgacactcaagtcgggtaacgctgcattgctgcgcggcagctcgtcggccgcaaagtccaacgaggccctggtggcggtgttacgcaccgcgctggtcggcctggagctgccggccgacgcggtccagctgctgtcggctgccgaccgcgccaccgtcactcacctgattcaggcccgcggcctggtcgatgtggtgattccacgcgggggagcgggcctgatcgaggcggtcgtacgcgatgcccaggtgcccaccatcgagaccggcgtcgggaactgccatgtctacgtgcaccaagcggccgacctggacgtggccgagcgtatcttgctgaactccaagacgcggcggcccagcgtctgcaacgccgccgagacgctgctggtcgacgcagcgatcgccgaaacggcgttgcctcgattgctggccgccctgcagcacgccggtgtcaccgtacatctcgacccggacgaggccgacctgcgccgcgaatacctgtcgctggacatcgcggtggcggtggtcgacggtgtcgacgctgccatcgcccatatcaacgaatacggcaccgggcacacagaagcgattgtgaccaccaatcttgatgcggcccaacgctttaccgaacagatcgatgcggccgcggtgatggtgaacgcatcaacggcgttcaccgacggcgagcaattcggcttcggcgccgagatcggcatctccacccagaaactgcatgcccgcggaccgatgggactaccggaattgacgtcgaccaagtggatcgcatggggagccggccacacccgtccggcctga

SEQ ID NO: 92 - DNA, 2217 bp, Mycobacterium tuberculosis
atgggactgctcggcggccaatcagggcccagggtcggcagcggcccagtcggtagcatccccacgccggtcaatgccgccatctgccagcagcgcgggggattccacggtgtcgagcgtggatactcggcgggtgattcgggcgttctgacgtcgctgggcgacaatgaaaggacgatgaacttttactccgcctaccagcacgggttcgtgcgcgttgccgcctgcactcaccacaccaccatcggtgacccggcggccaacgccgcgtcggtattggacatggcccgtgcgtgccacgacgatggcgcagcgttggcggtctttcctgagctgacgctgtcgggctactccatcgaggacgtactactgcaggactctctgctcgatgccgtcgaggacgcgctgctcgacctggtgaccgaatccgccgacctgttacctgtactggtggtcggggctccgctgcggcatcgacaccgcatctacaacaccgcggtcgtcattcaccgcggcgccgtgctcggcgtggtgcccaagtcgtatctacccacctatcgcgagttctacgagcggcgccagatggcgcccggagacggggagcggggcacgatccgcatcggtggcgccgacgtggccttcggcacggacctgttgttcgccgcgtcagatctacccggctttgtgttgcatgtggagatctgcgaggacatgtttgtgccgatgccgcccagcgccgaggcggccctggcgggcgcgacggtgctggcgaatctgtccggcagcccgatcaccatcggccgtgccgaggaccgccggctgcttgcgcgctcggcgtcggcgcggtgtctggctgcctatgtctatgccgccgcgggggagggggagtcaacgacggacctggcctgggacggtcagacgatgatctgggagaatggcgcactgctcgcggagtccgaacgtttccccaaaggagtgcgccgcagtgtcgccgacgttgacaccgagttgcttcggtcggagcggctgcggatgggcacgttcgacgacaaccggcgtcaccaccgggagttaacggaatcgttccggcgcatcgacttcgcactcgacccaccggcaggcgacatcggactgctgcgcgaggtcgagcggttcccgttcgttccggccgatccgcaacgattgcaacaggattgctacgaggcctacaacatccaggtgtctggactcgagcaacggttgcgggcgctggactatccgaaggtcgttatcggtgtgtccgggggattggactcgacgcacgcgctgatcgtcgcgacccatgccatggaccgcgagggccggccgcgcagcgacattctggcgtttgcgttgcccggattcgccaccggggagcacactaagaacaacgcgatcaagctggcacgtgcgctgggggttaccttctccgaaatcgatatcggcgacaccgctcggttgatgctgcacacaatcggccatccgtattcggttggcgaaaaagtgtacgacgtcaccttcgagaacgtccaggccgggttgcgcaccgactatcttttccgtatcgccaaccagcgcgggggaatcgtactgggcaccggggacctgtcggagctggcactgggttggtcgacatacggtgtcggcgaccagatgtcgcactacaacgtcaacgccggtgtgcccaagacgctgatccagcacctgatccggtgggtcatttcggcgggtgagttcggtgagaaggtgggtgaggtattgcagtcggtgctcgacaccgagatcacccccgaactcattccgaccggcgaggaggagctgcagagcagcgaggccaaggtcggacctttcgccctacaggacttttcgctttttcaggtactgcgctacggatttcgcccgtcgaagattgcgtttttggcctggcatgcgtggaacgatgcggagcggggcaactggccgcccggcttcccaaagagcgaacgcccgtcctattcattggccgaaatccggcattggctgcagattttcgtccagcggttttattcgtttagccagttcaagcgttcggcattgcccaacggccccaaggtgtcccacgggggcgcgttgtcgccgcgtggggattggcgggccccgtcggatatgtcagcgcgaatctggctcgatcagatcgaccgtgaggtgcccaagggctag

SEQ ID NO: 93 - DNA, 1131 bp, Mycobacterium tuberculosis
atgagaagtccgcatcgggacgcaatccggaccgcgcgcggccttgtcgtgaaggtcgggaccacggcgcttaccacaccgtccgggatgttcgatgccggccggctggccggactggccgaggcggtcgagcggcggatgaaggcgggttccgacgtcgtcatcgtgtcttcgggcgccatcgccgccggcatcgagccgctcgggctgtcccgtcgtcccaaagatctggcgaccaagcaggcggcggccagcgtcgggcaggtcgcgctggtgaactcgtggagcgcggcgttcgcccgctacggccgcacggtgggccaggtgctgctgaccgcgcacgacatttcgatgcgggtgcagcacaccaacgcccaacgcacgctggatcggctgcgcgcgttgcacgcggtggcgattgtcaacgagaacgacaccgtggccaccaacgagatccggttcggtgacaacgatcggctgtctgcactggtggcgcacctggtcggcgccgacgctttggtgctgctgtcggacatcgacggcctctacgactgcgacccgcgcaaaaccgcggacgcgacgttcattccggaggtgtccgggccggcggatctggacggtgtggtcgccggccgcagtagccacctgggtactggcggcatggcgtccaaggtggcggcggcgctgttggccgccgacgccggggtgccggtactgctggcccccgcggccgacgccgcgaccgcgctcgccgacgcgtcggtgggcacggtgtttgcggcccggcccgcgcgtctgtcggcccggcggttctgggtgcgttatgccgccgaagcaaccggcgcactgactctcgacgccggtgcggtgcgcgctgtggtgcgacaacgccggtcactgctggcggcgggtatcaccgcggtgtccggccggttttgcggcggcgatgtggtcgaactgcgtgcacccgacgcggccatggtagcccgcggggtggttgcctacgacgcgtccgagctggccaccatggtgggccggtccacctctgagctacccggcgagctgcgccgcccggtggtgcacgccgacgatctggtcgcggtgtcggcgaagcaagctaagcaagtttag

SEQ ID NO: 94 - DNA, 1440 bp, Mycobacterium tuberculosis
gtgcctcggtttgtcgatcgggtcgtcatccacaccagagcgggttcgggcggtaacggctgcgcttcggtccatcgcgagaaattcaagccgctgggcggccccgatggcggaaatggcggccggggcggcagcatcgtcttcgtcgtcgatccgcaagtgcacaccctgctcgacttccatttccgcccgcatctcaccgcggcttcgggcaagcacgggatgggcaataaccgcgacggggccgccggcgcggatttggaagtgaaagttcccgaaggcaccgtggtattggacgagaacggccggctactggccgacctggtcggcgcgggcacccgctttgaagccgccgccggaggccgtggcggtttgggcaacgccgcgctggcttcccgcgtgcgtaaggcccccggtttcgcactcctcggcgaaaagggacagtcccgagacctcaccttggaactcaagaccgtcgccgacgtcggcctggtcgggtttccgtcggccggaaaatcctcgctggtgtcggcgatttcggcggccaagccgaagatcgccgactacccgttcaccaccctggtgcccaacctcggtgtggtctcggctggcgagcacgcgttcaccgtcgccgacgtgccggggttgatcccgggcgcatcccggggccgtggtctggggctggactttctgcggcacatcgagcgctgcgctgtactggtgcatgtggtggattgcgctaccgccgagccgggccgcgaccccatctcggacatcgacgcgctggaaacggaactcgcgtgctacacgcccacgctgcaaggggacgcggctctgggcgatctcgccgcacggccgcgtgcggtggtcctcaacaaaatcgatgtgccggaggcccgcgagctcgcggagttcgtccgtgacgacatcgcccagcgcggctggccggtgttctgcgtgtcgaccgcaacccgggaaaacctgcagccgttgatctttgggctgtcgcagatgatctcggactacaacgctgcgcggccggtggcggtgccacggcggccggtgattcgtccgattccggtggacgacagcggttttaccgtcgaacccgacgggcatggtggctttgtcgtcagcggtgcccggcccgagcgttggattgaccagaccaacttcgacaacgacgaggccgtcggctatctcgccgaccggctggcgcgcctgggtgtcgaggaggaattgctgaggctgggtgcgcggtcaggatgcgcggtgaccatcggcgagatgacgttcgattgggagccgcaaacgcctgcgggtgagccggtcgcgatgtccggccggggcaccgatccgcggctggacagcaacaagcgggtgggcgcggccgagcgaaaggccgctcggagtcggcgtcgcgaacacggggatggctga

SEQ ID NO: 95 - DNA, 261 bp, Mycobacterium tuberculosis
atggcacacaagaagggggcttccagctcgcgcaacggtcgcgattccgccgcccagcggctgggggttaagcggtacggcggccaggtcgtcaaggccggcgagatcctggtccgccagcgcggtaccaaattccatcccggcgtcaacgtcgggcgtggcggcgatgacaccttgttcgccaagacggccggggcggtcgagttcggcatcaaacgcggacgtaagacggtgagcatcgtcggttcgaccactgcctga

SEQ ID NO: 96 - DNA, 315 bp, Mycobacterium tuberculosis
atgatggcgacctacgcaatcgtcaagaccggcggcaagcagtacaaagtcgctgtcggagatgtggtcaaggtcgaaaagctggaatccgagcagggggagaaggtgtccctgccggtggctctggttgtcgacggcgccaccgtcaccaccgatgcgaaggcactggccaaggtcgcggtgaccggtgaggtgctcgggcacaccaagggccccaagatccgtatccacaagttcaagaacaagactggctaccacaaacggcagggacaccgtcagcagctgacggtcctgaaggtcaccggcatcgcataa

SEQ ID NO: 97 - DNA, 2631 bp, Mycobacterium tuberculosis
atgctgcccaagtcgtgggatccggccgcgatggagagcgccatctatcagaagtggctggacgctggctacttcaccgcggacccgaccagcaccaagccggcctattcgatcgtgctgccgccgccgaacgtgaccggcagcctgcacatgggccacgcgctggaacacaccatgatggacgccttgacgcggcgcaagcggatgcagggctatgaggtgctctggcagccgggcaccgaccatgccgggatcgccacccagagcgtggtcgagcagcagctggcggtcgacggcaagactaaagaagacctcggccgcgagctgttcgtggacaaggtgtgggattggaagcgagagtctggcggtgccatcggcggccagatgcgccgactcggtgacggggtggactggagccgcgaccggttcaccatggacgaaggtctgtcgcgggcggtgcgcacgatcttcaagcggctttatgacgccgggctgatctatcgggccgagcggctggtcaactggtcgccggtgctgcagaccgcgatctccgacctcgaggtcaactaccgcgacgtcgaaggcgagctggtgtcgtttaggtacggctcgcttgacgactcgcaaccccacatcgtggtcgccaccacccgggtcgagacgatgctgggcgataccgcgatcgccgtccatcccgatgacgagcgctaccgtcacctggtcggcaccagcctggcgcacccattcgtcgaccgggagctggccattgtcgccgacgagcacgtggaccctgaattcggcaccggcgcggtcaaagtcacacccgcccacgaccccaacgacttcgaaatcggggtgcgccaccagctgccgatgccctcgatcctggacaccaagggccggatcgtcgacaccggaacgcgattcgacggcatggaccgcttcgaggcacgggtcgcggtgcgccaagcgctcgcggcccagggccgcgtggtcgaagaaaagcgaccctacctgcacagcgtcggacactccgaacgcagcggcgagccgatcgagccgcggctatccctgcagtggtgggtccgggtggaatcgctggccaaagcggccggggatgcggtgcgcaacggggacaccgtgattcacccggccagcatggaaccccgctggttctcctgggtcgacgacatgcacgactggtgcatctcgcgacagctctggtgggggcatcggatcccgatctggtacggacccgacggcgaacaggtgtgcgtcggcccggacgaaacacccccgcagggctgggaacaggatcctgacgtgctggatacctggttttcgtcggcgctgtggccgttttccacgctgggttggccggacaagacggcggagctggaaaagttctatccgacaagcgttctggttaccggctatgacatcttgttcttttgggtggccagaatgatgatgttcggcaccttcgtcggcgacgacgccgccatcaccctcgacggccgccggggcccgcaggtgccgttcaccgacgtgtttctgcatgggctgatccgcgacgagtctggccgcaagatgagcaagtccaagggcaacgtcatcgacccgctggattgggtggaaatgttcggggccgatgcgctgcggttcacgctggcccgcggggccagtcccggtggtgacttggcggtgagcgaggatgccgtgcgggcgtcgcgcaatttcgggaccaagctgttcaacgccactcggtacgcactgctcaatggcgccgcgccagcacccctgccatcgccgaacgagctgaccgacgccgaccgctggattctcggaaggttggaagaggttcgggccgaagttgattcggccttcgacggatacgagttcagccgcgcttgtgagtccctgtatcacttcgcctgggacgaattctgcgactggtacctcgaactggccaaaacgcagcttgcccagggactcacacacaccaccgccgtgctggccgccgggctggacacgctgctgcgcctgctgcacccggtgattcccttcctcaccgaggcgctatggctggcgctgaccggcagggaatcgctggtcagcgccgactggccggagccttccgggattagcgtggaccttgttgccgcgcaacggattaacgatatgcagaagttggtgaccgaagtgcggcggttccgcagcgatcaaggtctggccgaccggcagaaggttccggcccgaatgcacggtgtgcgggactcggatctgagcaaccaggtggccgccgtgacctcgctggcgtggctcaccgagccgggcccggattttgagccgtcggtctcgttggaggttcggctcggccccgagatgaaccgcaccgtcgtcgtcgagctcgacacctcgggcaccatcgacgtggccgccgagcgtcgccgcctggaaaaggagttggccggcgcccaaaaggagctggcgtcgaccgccgccaagttggccaacgcggactttctggccaaagcgcccgacgccgtcattgccaagatccgggaccgccagcgcgtggcgcagcaggaaaccgagcgcatcaccacccggttggctgcgctgcaatga

SEQ ID NO: 98 - DNA, 2370 bp, Mycobacterium tuberculosis
gtgaccaaaccggcggccgatgccagcgcggtgcttactgccgaggacacactggtgctggcttccacggcgacgccggtcgagatggagctgatcatgggctggctgggccagcagcgtgcacgccatccggactcgaagttcgacatattgaagctgccaccgcgcaacgctccgccggcggcgctgacggcactggtcgagcagctcgagcccggcttcgcatccagcccgcaatctggcgaggaccgttctatcgtgccggttcgggtgatctggctgcctcccgccgatcgcagccgggcgggcaaggtggccgcactgctcccgggtcgggatccctaccatcccagccagcgtcagcagcgtcgcatcctgcgtaccgatcccaggcgcgcgcgggtggtggccggcgagtcggccaaggtgtccgaactgcgccagcagtggcgcgataccacggtggcagagcacaagcgcgatttcgcccagttcgtcagccgccgagcgctgttggcgctggcgcgcgccgaatatcggatccttggaccgcaatacaaatctccccggctggtgaagccggagatgttggcgtccgcacgatttcgtgccggcctggaccggattccgggcgccacggtcgaagatgccgggaagatgctcgacgaactctccaccggatggagccaggtgtcggtagacctggtttccgtcctcggcaggctggctagccgcggcttcgatccggaattcgactacgacgagtatcaggtcgcggcgatgcgcgccgcactggaggctcatccggcggtcctgctgttctcgcaccggtcctacatcgacggcgtggtggtaccggtggccatgcaggacaaccggttaccgccggtgcacatgttcggcggcatcaacctgtcgttcggtctcatgggacccctcatgcggcgctcggggatgatcttcatccggcgcaatatcggcaacgacccactgtataagtacgtgctcaaggagtacgtgggctacgtggtcgagaagcggttcaacctgagctggtccatcgaaggcacccggtcgcgcaccggaaagatgttgccgcccaagctcggtttgatgagctacgtggccgatgcttacctggacggccgcagtgacgacatcctgctgcagggggtttcgatttgcttcgatcagctgcacgagatcaccgaatacgccgcctacgcgcgtggcgcggagaagacgcccgaaggtttgcgctggctctacaacttcatcaaggcgcagggggaacgcaacttcggcaagatctacgttcgcttccccgaagcggtctcgatgcgccagtacctcggcgcaccgcacggcgagctgacccaggatccggccgcgaaacggcttgcgttgcagaagatgtcgttcgaggtggcctggaggattttgcaggcgacgccggtgaccgcgacgggtttggtgtccgcactgctgctcaccacccgcggcaccgcgttgacgctcgaccagctgcaccacacgttgcaggactcactggactatctggaacgcaaacaatcgccggtttcgacaagcgcattgcgactgcgctcgcgcgaaggcgtccgtgcggcggcggacgcgttgtccaacggccacccggtcactcgggtcgacagtggccgggagccggtatggtacatagcgcctgacgacgagcacgccgcggcgttctaccggaactcggtgatccatgcgtttttggagacctcgatcgtcgagctcgcgctggcccatgccaagcacgccgaaggtgaccgcgtcgccgcgttctgggcccaggcgatgcggttgcgggatctgctgaagttcgacttctatttcgcggattccacggcgtttcgggccaacatcgcccaagagatggcctggcaccaagactgggaggatcatcttggcgtcgggggcaatgagatcgacgcgatgctgtatgccaaacggccgctgatgtcggacgcgatgttgcgggtcttcttcgaagcctatgagatcgttgccgacgtgttgcgcgatgctccgcctgacatcggtcctgaggagttgacggagctggcgctcggcctcggccgtcagtttgtggcacagggccgggtccgcagcagcgaaccggtatcgacgctgctgttcgccactgcacgccaggtcgccgtcgatcaggagctgatagcgccggcggccgacctcgccgaacgtagggtcgccttccggcgggagttacgaaacattctgcgggatttcgactatgtcgagcagatcgcgcgcaaccagttcgtcgcctgcgagttcaaagcgcgtcaaggacgcgaccgaatctaa

SEQ ID NO: 99 - DNA, 807 bp, Mycobacterium tuberculosis
atgccgatacccgcgcccagccccgacgcacgtgccgttgtcaccggggcttcgcagaacatcggcgcggcgctggccaccgaactggccgcacgcgggcaccacctgatcgtcaccgcacgacgcgaggacgtgttgaccgagttggctgcccggctggccgacaagtaccgcgtcacggtcgacgtgcgaccggccgatctggccgatccgcaagaacgatcgaaactggccgacgagctggctgcccggcccatctcgatcctgtgcgccaacgcgggtaccgcgacattcggcccgatcgcatcgctcgatcttgccggcgaaaagacgcaggtgcagttgaatgccgtggcggtgcacgaccttacgttggcggtgttgccgggcatgatcgagcgcaaggccggcggcatcttgatttctggttcggcggccggcaattcaccgattccctacaacgccacctatgccgcgaccaaggccttcgtgaacaccttcagcgaatctctgcgcggtgagctacgcggctccggcgtgcacgtcacggtgctggccccgggcccggttcgcaccgagctaccggatgcctccgaagcgtcactggtcgagaagctggtgccggacttcctgtggatctcgacggagcacaccgcccgggtatcgctgaatgccttggagcgcaacaagatgcgcgtcgttccgggtctgacgtcaaaggcgatgtcggtggccagccaatacgctccgcgcgccatcgtggcgccaatcgtgggtgccttttacaagaggcttgggggcagctag

SEQ ID NO: 100 - DNA, 9210 bp, Mycobacterium tuberculosis
gtgacgatccacgagcacgaccgggtgtccgctgatcgcggcggggacagcccgcataccacccacgctctggtcgatcgcctcatggctggtgagccctacgctgtcgcattcggtggccagggcagcgcctggctggaaaccctcgaagagctggtgtcggccaccgggatagaaaccgagttggcgacgttggtcggtgaggcagagctgttgctcgatccggtcaccgacgagctgattgtggtgcgcccgatcggtttcgagccgctgcaatgggtacgcgcactggcggccgaggacccggttccgtccgacaagcacctgacgtcggccgccgtgtcggtgcccggcgtgttgcttacccagatcgcggcgacccgggcgctggcccgtcaaggcatggacctcgtggccaccccgccggtcgccatggcggggcattcgcaaggtgtgctggcggtggaagccctcaaggctggtggggcacgcgacgtcgagctgtttgccttggcccagttgatcggtgccgccggaacgctggtggcccgccggcgcggaatttccgtcctgggcgatcgcccgccgatggtatcggtcaccaacgccgaccccgagcgcatcggccggttgctcgacgagttcgcccaggacgtgcgcacggtgctgccaccggtgttgtccatccgcaacggccggcgtgccgtcgtcatcaccggcacccccgagcagctgtcgcgtttcgagctttattgccgccagatctccgagaaggaagaagccgaccgcaagaacaaggtccgcggcggcgacgtcttctcgccggtcttcgagccggtgcaggtggaggtgggctttcacaccccgcggctatccgacgggatcgacatcgtcgcgggctgggccgagaaggcgggcctcgatgtcgccttggctcgggagctggccgatgccatcttgatcagaaaggtcgactgggtcgacgagatcacccgtgtccacgcggccggcgcccgctggatcctcgacctggggccgggcgacatcctgacccgactgaccgcaccggtgatccgcggcctgggcatcggcatcgtgccggcggctacccgcggtggccagcgcaacctgttcaccgtcggcgccacccccgaggttgcccgggcctggtcgagctacgcaccgaccgtggttcgcctccccgacggcagggtcaagctctcgacgaagttcacccggctgaccggccgctcgccgatcctgctcgcgggcatgaccccgaccaccgtggacgccaagatcgtcgccgcggcggccaacgccgggcactgggccgagctggccggcggcgggcaggtcaccgaagagatcttcggtaaccgcatcgaacaaatggccggcctgctcgagccgggccgcacctatcagttcaacgcgctgttcctcgatccctacctgtggaagcttcaggtgggcggcaagcggttggtgcagaaggcccgccagtccggcgccgcgatcgacggcgtggtgatcagcgccggcatcccagacctcgacgaggccgtcgagctgatcgacgaactgggcgacatcggcatcagccacgtcgtgttcaaacccgggaccatcgagcagatccgctcggtgattcgcatcgccaccgaggtgcccaccaagccggtgatcatgcacgtcgagggcgggcgcgccggcgggcaccattcctgggaggatctcgacgacctgctgctggctacctactcggagttgcgctcacgcgccaacatcacggtgtgcgtcggcggcggcattggcaccccgagaagggctgcggaatatttgtccgggcgctgggcgcaggcctacggcttcccattgatgccgatcgacggcatcctggtcggcaccgcggcgatggccaccaaggaatccaccacgtcgccatcggtcaagcggatgctcgtcgacactcagggcaccgaccaatggatcagcgccggaaaagcgcagggcggcatggcctccagccgcagtcagctcggtgccgatatccacgagatcgacaacagcgcatcccggtgcgggcggctgctcgacgaggtggccggtgacgcggaggcggtcgcggagcgtcgcgacgagatcatcgcggcgatggccaagaccgccaagccctacttcggcgacgtcgccgacatgacctacctgcagtggctgcggcgctacgtcgaactggccatcggggaaggcaactcgaccgccgacaccgcctcggtgggcagcccgtggctggccgacacctggcgggaccgcttcgagcagatgctgcagcgtgccgaagcccggttgcacccacaggatttcggcccgatccagacgctattcaccgatgctggcctgctggacaatccgcagcaggcgatcgccgccctgctggcgcgctaccccgacgccgagaccgtgcagttgcatcccgcggatgtgccctttttcgtgacgttgtgcaagacgctgggcaagccggtcaacttcgtgccggtgatcgaccaggacgtgcggcgctggtggcgcagcgactcgctgtggcaggcccacgacgcccgctacgacgccgatgcggtgtgcatcattccgggcaccgcgtcggtagccggcatcacccggatggatgaacccgtcggtgagttgctggaccgtttcgagcaagccgcaatcgatgaagtgctcggcgccggtgtcgagccgaaggatgtcgcgtcgcgccggctgggccgcgccgacgtggccggaccgttggctgtcgtcctcgacgcacccgatgtgcgctgggccggtcgcaccgtgaccaacccggtgcatcggatcgccgacccggccgaatggcaggtgcacgatggacccgaaaacccgcgcgccacacactcatccaccggcgcccggctgcagacgcacggcgacgacgtcgccttgagcgtgcccgtctcgggcacctgggtcgacatccgattcacgttgccggccaacaccgtcgatggcggcaccccggtgatcgccaccgaggacgccaccagcgccatgcgcacggtgctggcgatcgccgccggtgtcgacagcccggagttcttgcctgcggtggccaacgggacggccactttgacggtggactggcaccccgagcgtgttgccgaccacaccggcgtcaccgccacgttcggtgagccgctggcacccagcctcaccaacgtgcccgacgcgctcgtcggcccttgttggccagcggttttcgcggccatcggatcggcggtcaccgacaccggtgagccggtggtggaaggcctgctgagcctggtgcatctggaccacgccgcccgcgtggtcggtcagctgcccacggtcccggcccaattgaccgtcaccgcaacggctgccaacgcaaccgatacggacatgggccgcgtcgtgccggtctcggtcgtcgttaccggcgccgatggcgccgtgatcgccactctcgaggagcgattcgcgatcctgggtcgcaccggttccgccgagctcgccgacccggcgcgagccggtggcgcggtgtcggcgaacgccaccgacaccccgcgccgtcgccgccgcgacgtcacgatcaccgcgccggtcgacatgcgcccgttcgcggtggtgtccggcgaccacaaccccattcacaccgaccgggccgccgcgctgcttgccggcctggagtcgccgatcgtgcacggcatgtggctgtcggccgcggcgcaacacgcggtgaccgccaccgacgggcaggcccggccaccggcccggctggtcggctggaccgcgcggtttttgggcatggtgcgccccggcgacgaggtggacttccgcgtcgagcgcgtcggaatcgaccagggcgcagagattgtggacgtggccgcgcgcgtcgggtcggatctagtgatgtcggcctccgcgcgactggccgcacccaagacggtctacgcattccccggccagggcatccaacacaagggcatgggcatggaggtgcgcgcccgctccaaggcggcccgcaaggtgtgggacaccgcggacaagttcacccgcgacaccctgggcttctcggtactgcacgtggtccgcgacaacccgaccagcatcatcgccagcggtgtgcactaccaccaccccgacggggtgctctacctgacgcagttcacccaggtcgcgatggcgacggtggcggccgcgcaggtcgccgagatgcgtgaacagggagccttcgtcgaaggcgccatcgcgtgcggccactcggtcggcgagtacaccgcgctggcctgcgtgaccggcatctaccaactggaagccttgctggagatggtgtttcaccgcgggtcgaagatgcacgacatcgttccgcgcgacgagctcggccgctccaactatcggctggcggccatccggccgtcccagatcgacctcgacgacgccgacgtgcccgcgttcgtcgccgggatcgcggagagcaccggtgaattcctggagatcgtgaatttcaacctgcgtggctcgcaatacgcgatcgcgggcacggtacgcggcctcgaggcgctcgaggccgaggtggagcggcgccgcgagctcaccggcggccgacggtcgttcattttggtgcccggcatcgatgttccgttccactcgcgagtgctgcgggtcggggtggccgaattccggcgctcgctggaccgggtcatgccgcgcgacgcggaccccgacctgatcatcgggcgctacattcccaacctggtgccgcggttgttcaccctggaccgcgacttcatccaggaaatccgggatttggtgcccgccgagccgctcgacgagatcctcgccgactacgacacctggcttcgcgagcgtccgcgcgagatggcgcgcacggtgttcatcgagctgctggcatggcaattcgccagcccggtgcgctggatcgagacgcaggatctgctgttcatcgaggaggccgccggcgggctgggtgtggagcgattcgtcgagatcggtgtgaagagctcaccgacggtggcgggtcttgccaccaacaccctcaaactgcccgaatacgcccacagcacagtggaagtgctcaacgccgagcgtgatgccgcggtgctgttcgccaccgacaccgacccggagccggagccggaggaagacgagccggtcgcggaatcgcccgcgccggacgtcgtctcggaagccgcccccgtcgcgccggccgcttcgtcggcgggcccgcgtcccgacgatctggttttcgacgccgccgatgccacgctggcgctgatcgcgctctcggccaagatgcgcatcgaccagatcgaagaactcgactccatcgagtccatcaccgacggtgcgtcgtcgcggcgcaaccagctgctggtggacctgggctccgagctgaacctcggtgccattgacggcgccgccgaatcggacctggccggtctgcgctcacaggtgaccaaactggcgcgcacctacaagccttacggcccagtgctttccgacgccatcaacgaccagcttcgcaccgtcctcggaccgtcgggcaagcggcccggcgccatcgccgagcgggtgaagaagacctgggagctcggtgagggctgggccaagcatgtcaccgtcgaggtcgcgctgggcacccgcgagggcagcagcgttcgcggcggcgccatgggccacctgcacgagggcgcgctggccgatgccgcctccgtcgacaaggtcatcgacgcggcggtcgcatcggtggccgcgcgccagggcgtttcggtagcgctgccgtcggccggtagtggtggcggcgccaccatcgacgcggccgcgctcagcgagttcaccgaccaaatcaccggccgtgagggcgtgctggcctccgcggcccgcctggtgctggggcagctgggactggacgaccccgtcaacgccttgccggccgcccccgattccgagctgatcgacttggtcaccgccgaactgggagcggactggccgcggttggtggcaccggtgttcgaccccaagaaggccgtcgtattcgacgaccgctgggccagcgcccgcgaggacctggtgaagctgtggctgaccgacgagggcgacatcgacgccgactggccgcgcctggcggagcgcttcgagggtgccggccacgtcgtggcgacccaggctacctggtggcaaggtaagtcgctggccgcgggccggcagatccatgcatcgctgtacggccgcatcgccgccggcgccgagaaccccgaacccggccgctacggcggcgaagttgccgtggtgaccggcgcttcgaagggttcgatcgccgcgtcggtggtggctcggctgctcgacggcggagccaccgtcatcgcgaccacctccaagctcgacgaggagcggctggcgttctaccgcacgctgtatcgcgaccacgcccgttacggcgcggcgctgtggctggtcgcggcgaacatggcgtcctactccgacgtcgacgccctggtcgaatggatcggcaccgaacagaccgaaagccttgggccgcagtcgattcacatcaaagacgcgcagaccccgacgctgctgttcccgttcgcggcgccacgcgtggtcggggacctgtcggaggccggttcgcgcgccgagatggagatgaaagtgctgctgtgggccgtgcaacggctgatcggcggcctgtcgacgatcggcgccgaacgcgacatcgcgtcgcggctgcacgtggtgctgcccggctcgcccaaccgtggcatgttcggcggcgacggcgcctacggcgaagccaagtccgcgctggatgccgtggtgagccgctggcacgccgagtcgtcctgggcggcacgggtcagcctggcgcacgcgctcatcggctggacccgcggcaccgggctgatgggccacaacgatgccatcgtggccgccgtcgaagaggccggggtcaccacctactcgaccgacgagatggcggcgctgctgctcgacctgtgtgatgcggaatccaaggtggctgcggcgcgttcgccgatcaaggccgacctgaccgggggcctggccgaggccaacctcgacatggccgagctggcggccaaggcgcgcgagcagatgtcggcagcggcggccgtcgacgaggacgccgaggcccctggcgccatcgccgcgctgccgtcgccgccccggggtttcacccccgcaccgccgccgcaatgggacgacctcgatgtcgacccggccgacctggtggtgatcgtcggcggcgccgaaatcggcccgtacggctcgtcacgcacccggttcgagatggaggtcgaaaacgagctgtcggcggccggcgtgctggagctggcctggaccactgggttgatccgctgggaggacgacccgcaacccggttggtacgacaccgaatccggcgaaatggtcgacgaatccgagttggtgcagcgctaccacgacgccgtggtgcagcgcgtcggcattcgcgaattcgttgatgacggcgcgatcgaccccgaccacgcctcgccgctgctggtgtcggtgttcctggagaaggacttcgcgttcgtggtgtcctcggaggccgatgcgcgcgccttcgtcgagttcgatcccgagcacacggtcatccggccggtgcccgactccaccgactggcaggtcatccgcaaggccggcaccgagatccgggtgccgcgaaagaccaagctgtcccgcgtcgtcggcggccagatcccgaccgggttcgacccgacggtgtggggcatcagcgcagacatggccggttccatcgaccggttggcggtatggaacatggtggcgaccgtcgacgcgttcctgtcgtccggtttcagcccggccgaggtgatgcgttacgtgcacccgagtttggtggccaacacccagggcaccggcatgggcggcggcacgtcgatgcagacgatgtaccacggcaatctgttgggccgcaacaagccgaacgacatcttccaggaagtcttgccgaatatcattgccgcgcacgtggttcagtcctacgtcggtagctacggtgcgatgatccacccggtagccgcgtgcgccaccgccgcggtgtcggtcgaggaaggtgtcgacaagatccggttgggcaaggctcaactggtggtggccggcggcctggatgacctgacgctggagggcatcatcggattcggtgacatggccgccaccgccgacacgtccatgatgtgcggccgcggcatccacgactcgaagttttcccggcccaacgaccgccgccgtctgggcttcgtcgaagcccaaggcggcgggacgatcctgttggcccgcggggacctggcgctgcggatggggctgccggtgctggcggtggtggcgttcgcgcagtcgttcggcgacggcgtgcacacctcgatcccggccccgggcctgggcgcgctgggggcgggccgcggcggcaaggattcaccgctggcgcgggcgctggccaagctgggcgtggccgccgacgacgtggcggtcatctccaagcacgacacctcgacgctggccaacgatcccaacgagaccgagttgcatgaacggctcgccgacgccctgggccgttccgagggcgccccgctgttcgtggtgtcgcagaagagcctgaccggccacgccaagggcggcgcggcggtcttccagatgatggggctctgccagatattgcgggatggggtgatcccacccaaccgcagcctcgactgcgtcgacgacgagctggccggctccgcgcatttcgtgtgggtgcgtgacacgttgcggctcggcggcaagttcccactcaaggccggcatgctgaccagcctcgggttcggccatgtgtcgggcctggtcgcgttggtgcatccgcaggcgttcatcgcctcgctggatcccgcacagcgcgcggactaccagcggcgtgccgacgcccgcctgctggccggtcagcgccggctggcctcggcgattgccggtggtgcgccgatgtaccagcggcccggtgaccgtcgcttcgaccaccacgcgcccgagcggccgcaggaggcgtcgatgctgctgaatccggcggcccggctgggtgacggcgaggcgtatatcggctga

SEQ ID NO: 101 - DNA, 2715 bp, Mycobacterium tuberculosis
gtgcagacacacgagatcaggaagcggttcctcgatcatttcgtgaaggcgggccacaccgaggtgcccagcgcctcggtgatcctcgacgaccccaacctgttgttcgtcaacgccgggatggtccagttcgtgcctttcttcttgggacagcgcacgccgccgtacccgacggccaccagcatccagaagtgcatccgtacccccgatatcgacgaggtgggcataaccacccggcacaacacgttttttcagatggccggcaatttcagcttcggcgactatttcaaacgcggggccattgaactggcctgggcactgctgaccaacagcctcgccgccggcggctacggcctggacccggaaagaatctggacgacagtctatttcgacgacgacgaagctgtccggctatggcaggaggttgccgggctgccggcggagcgaatccagcgccgcggcatggccgacaactactggtcgatgggcattcccggaccgtgcgggccgtcatcggagatctattacgaccgcggacccgaattcggtcccgcaggcggtcccatcgtcagcgaagaccgctacctcgaggtctggaacctggtgttcatgcagaacgagcgcggagagggaaccaccaaggaggactaccagatcctcgggccgctgccccgcaagaacatcgacaccggcatgggcgtcgagcggatcgcgctggtgctgcaagacgtgcacaacgtctacgagaccgacctgctcaggccggtcatcgataccgtggccagggtcgccgcgcgtgcctacgacgtcggcaaccacgaagacgacgtgcggtaccgcatcatcgcagaccacagccgcaccgccgcgatcctgatcggtgacggcgtcagccccggcaacgacggtcgcggttatgtgctgcgccggctgctgcgtcgggtgatccgctccgccaagctgctgggcatcgacgctgcgatcgttggcgacctgatggccacggtgcgcaacgcgatgggcccgtcatatcccgaactcgtcgccgacttcgagcggatcagccggatcgcggtcgccgaggagacggcgttcaaccgcacgctggcgtcgggttccaggctgttcgaggaggtggctagctccaccaagaaatccggagccaccgtgctgtccggatcggacgctttcacgttgcatgacacctacgggttcccgatcgagctcacgctggagatggcggccgaaaccggtctgcaggtagacgaaatcgggttccgtgagctgatggccgagcagcgccgccgtgccaaggccgacgccgccgcgcgcaaacacgcgcatgctgacctgagcgcctaccgcgagctggttgacgccggcgccaccgagttcaccggattcgacgagttgcgttcccaggcgcggattctgggcatcttcgtcgacggtaagcgggttccggtggtggcgcacggtgtagccggcggagccggggaagggcagcgtgtcgaacttgtcttagatcgcaccccgctctacgccgaatcgggtgggcagatcgccgatgagggcaccatcagcggaaccggttccagcgaagctgcccgggccgcggttaccgacgtgcagaagatcgccaaaacgctttgggtgcaccgagtcaacgtggaatccggggaattcgtcgagggtgacaccgtaatcgcggcggtggatcccgggtggcgccggggtgccacgcagggccactcgggcacccacatggtgcatgccgcgctgcgacaagtgctggggcccaacgcggttcaggcgggatcgctgaaccggccgggatatttgcgcttcgactttaactggcagggtccgttgaccgacgaccagcgcacccaggtcgaagaggtcaccaacgaggccgtgcaagcggacttcgaggtgcgcacgttcaccgaacagctcgacaaggccaaggcgatgggtgccatcgcgctgttcggcgagagctaccccgacgaagtgcgggtggtggagatgggtggaccgttctcgctggagctatgtggcggcacccatgtgagcaacacggcgcagatcggtcccgtgacgatcctgggcgagtcgtcgatcggctccggggtgcgccgggtggaggcctacgtggggttggattcgtttcgtcacctggccaaggagcgtgcgttgatggccgggttggcctcgtcactgaaggtgccgtccgaagaggtaccggcccgggtggccaatctagtggagcgcctgcgggccgccgagaaggaactcgaacgtgtccggatggccagcgcccgggcagccgccaccaatgccgccgccggggctcagcggatcggtaacgtccgtttggtggcgcagcgaatgtccggcgggatgaccgcggcagacctgcggtcgttgatcggcgacatccgcggcaagctgggtagcgagccggcggtggtggcgctgattgccgagggcgaaagccaaactgtgccgtatgcggtcgcggccaatcccgctgcccaggacctcggaatccgtgccaacgacctggtcaaacaacttgcggtggcggtcgaaggccgcggtggcggtaaggcggacctggcgcagggctcgggaaagaatccgaccggtatcgacgccgcgctcgacgcggtccgctccgagatcgccgtgatagcgcgggtcggttga

SEQ ID NO: 102 - DNA, 1272 bp, Mycobacterium tuberculosis
gtgacggaattctcgtcattttcggcccccaagggggtaccggactacgtcccgcccgactcggcgcagttcgtcgcggtgcgcgacgggctgctcgcggcggcccgtcaagccggctatagccacatcgagctgcccatcttcgaggacaccgccctgttcgcccggggcgtgggtgaatccaccgacgtggtgtccaaggagatgtatacgttcgccgaccgtggcgaccgctcggtgacgctgcggcccgagggcaccgccggggtggtgcgtgcggtgatcgaacacgggctggatcgcggcgcgctgccggtgaagttgtgttatgcgggcccgtttttccgctacgagcgtccgcaggccggccggtatcgccagttacagcaagtcggggtggaggcgatcggcgtcgacgacccggcgttggacgccgaggtgatcgccattgccgacgccgggttccgctcgttgggtctcgacgggttccggctggaaatcacctccctgggagacgagagttgccgtccgcagtaccgggaactgttgcaggagttcttgtttggactcgatctcgacgaggacacccgcaggcgcgcagggatcaatccgctgcgggtgctcgacgacaagcgacccgaattgcgtgcgatgacggcgtcggcgccggtgttgctggatcatctgtctgatgtcgccaagcagcatttcgacaccgtgctcgcccatctggacgcgcttggagtgccctatgtcatcaacccgcgcatggtgcgcggcctggactactacaccaagaccgccttcgagttcgtccatgacgggcttggtgcgcaatcggggatcggcggcggggggcgctacgacggcctgatgcaccagcttggcgggcaggacttgtcgggcatcgggttcgggctgggcgtggaccggaccgtgctggcgctgcgggccgagggcaagacggcgggggacagcgcccggtgcgacgtgttcggcgtgccgcttggcgaggcggccaagctcaggctggcggtgctggctggacgactgcgcgcggccggggtgcgggttgaccttgcctatggtgatcgcgggctcaaaggcgcgatgcgcgcggccgctcgttccggcgcccgtgttgcgttggtagcgggcgaccgcgacatcgaggccgggacggtcgcagtgaaggacttgacgacgggtgagcaagtttcggtctcgatggattcggttgtggccgaagtaatttcgcggctggctgggtag

SEQ ID NO: 103 - DNA, 2079 bp, Mycobacterium tuberculosis
atgagcgcccccgcacaacccgccccgggagtcgatggcggcgacccgtcgcaagcccgaattcgggttcctgccgggaccaccgcggccaccgccgtcggcgaagcgggtttaccgcggcgcggtacgcccgatgcgatcgtcgtcgtgcgcgacgccgacggcaacctgcgcgacctgagctgggtgcccgacgtcgacaccgatatcacgccggtggccgccaacaccgacgacggtcgcagcgtgatccgccattcgaccgcgcacgtgttggcccaagccgtccaagagctgtttccgcaggccaagctcggcatcggaccacccatcaccgacggcttctactacgacttcgacgtgcccgagccgttcacgcccgaggacttggcggcgctggaaaagcggatgcgccagatcgtcaaggaaggccagctgttcgaccggcgggtctacgaatccaccgaacaggcccgcgccgagctggccaacgagccctacaagctggaactcgtcgacgacaaatcgggtgacgccgagatcatggaggtcggcggtgacgagctcaccgcctacgacaacctcaacccccgcacccgcgagcgcgtctggggcgacctgtgccgcggaccgcacatcccgaccaccaaacacatcccggcgttcaagctcacccgcagctcggccgcctactggcggggcgatcagaaaaacgccagcctgcaacggatctacggcaccgcgtgggaatcccaggaggcgctcgacaggcacctggagttcatcgaagaggcgcagcgccgcgaccaccgcaagctgggtgtcgagctggacctgttcagcttccccgacgaaatcggttccggcctagcggttttccaccccaagggcggcatcgtgcgtcgcgaactggaggactactcgcggcgcaagcacaccgaggcgggctaccagttcgtcaacagcccgcacatcaccaaggcccagttgttccacacctcgggacatctggactggtacgccgacggcatgttccccccgatgcacatcgacgcggagtacaacgccgacggctcgctgcgcaaacccggccaggactactacctcaagccgatgaactgcccgatgcactgcctgatcttccgcgcgcgcgggcgatcctatcgggaactgccgttgcggctcttcgagttcggcacggtgtatcgctacgagaagtccggtgtggtgcacgggttgacccgggtgcgtgggctgaccatggacgacgcgcacatcttctgcacccgcgaccagatgcgcgacgagctgcggtcgctgctgcggtttgtgctcgacctgctcgccgactacggcctcaccgacttctacctcgaactgtccaccaaggacccggagaagttcgtcggcgccgaggaggtctgggaggaagccaccaccgtgctggccgaggtgggcgccgaatccgggctggagctggtgcccgatccaggcggcgcggcgttctacgggcccaagatttcagtgcaggtcaaagacgcgctgggccgcacctggcagatgtcgaccatccagctggacttcaactttccggaacgtttcggcctggagtacaccgccgccgacggaacccgccaccgcccggtgatgatccaccgcgcgctatttgggtcgatcgagcggttcttcggcattctcaccgagcactacgcgggggcgttcccggcctggttggcgcccgtgcaggtggtcggcatcccggtcgccgatgagcacgtcgcctatctggaagaggttgccacgcaactgaagtcgcacggggtgcgggccgaggtggacgccagcgacgatcggatggccaagaagatcgtgcaccacaccaaccacaaggtgccgttcatggtgttggcgggtgatcgtgacgtcgccgccggcgcggtgagtttccggttcggtgaccgcacccaaatcaacggtgtggcccgtgacgatgcggtggcggccattgtcgcctggatcgctgaccgcgaaaatgcggttcctacagcggaactggtgaaagtggccggtcgtgagtga

SEQ ID NO: 104 - DNA, 465 bp, Mycobacterium tuberculosis
gtgtcgaccactctggcgatcgtccgcctcgaccccgggctcccgctgcccagccgcgctcacgacggcgacgccggcgttgatctctacagcgccgaagacgtcgagctggcacctgggcgccgcgccctggtacggacgggtgttgcggtcgccgtcccgttcggcatggtcgggctggtccatccgcgctccgggttggccacgcgggtggggctttcgatcgtcaacagtccgggcaccatcgacgcgggttatcgtggggagatcaaggtggccctgatcaacttggacccagccgcgcccatcgtggtacatcgcggtgaccgaatcgcccagttgctagtgcaacgggttgagttggtcgagctggtcgaggtctcgtcgttcgacgaggccgggctggcctcgacatcccgcggcgacggtggccacggttcctccggcggacatgcgagtttgtga

SEQ ID NO: 105 - DNA, 1317 bp, Mycobacterium tuberculosis
atgccgcgacggtcaccagctgaccccgcggcggcgctggcgccgcggcgcaccaccctgccgggcgggctgcgagtggtcaccgaattcctgcccgcggtgcactccgcgtcggtcggggtgtgggtcggcgtcggatcgcgcgacgaaggcgccacggtggccggggcggcgcacttccttgagcatttgctgttcaagtcgacgcccacccgctctgccgtggacattgcgcaggcgatggacgcggtgggcggggaactgaacgcattcaccgccaaggagcacacctgctactacgcccacgtgctcggcagcgacttgccgttggccgtcgacctggtcgccgatgtggtgctcaacggccgctgtgccgccgacgatgtcgaggtggaacgtgacgtcgtcctcgaggagatcgcgatgcgcgacgacgaccccgaggacgccttggcggacatgttcctggcggcgttgttcggcgaccacccggtcggtcgcccggtgatcggcagcgcgcaatccgtgtcggtgatgacgcgggctcaactgcaatcgtttcacctgcggcgctataccccggagcggatggtcgtcgcggccgccggcaatgtggatcacgacgggctggttgcgttggtccgcgagcacttcgggtcccggttggtccgggggagacggccagttgcgccgcgcaagggtaccggccgggtcaacggcagcccccggttgacactggttagccgcgacgccgaacagacgcatgtgtcgctgggcatccgcacacccgggcgcggctgggagcatcgttgggcactgtcggtgctgcacaccgcgctgggcggtggcttgagttcccggctgttccaggaggtccgcgagacccgcgggctggcctactcggtctactccgcgctggatctcttcgccgacagcggcgcgctttcggtgtacgcggcctgcctgcccgaacgcttcgccgacgtgatgcgggtgaccgccgatgtgctggaaagcgtggcacgcgacggcatcaccgaggcggaatgcggcatcgccaagggatcgctgcggggtgggctggtgctagggctggaggattccagctcccggatgagccggctcggccgcagcgagttgaactacggcaagcaccgcagcatcgaacacaccttgcggcaaatcgagcaggtcaccgtggaggaggtcaacgcggtggcccgccacctgctgagcaggcgctacggtgctgccgttcttggcccacacggatcgaaacgatcactgccgcaacaacttcgagcgatggtagggtag

SEQ ID NO: 106 - DNA, 2259 bp, Mycobacterium tuberculosis
atgtctgccgctgaaattgacgaaggcgtgttcgagacgaccgccaccatcgacaacgggagctttggcacccggaccatccgcttcgagaccggccgattggccttgcaggccgccggcgcggtggtcgcctacctcgacgacgacaacatgctgctgtcggcgaccaccgccagcaagaaccccaaagaacacttcgacttcttccccctcacggtcgacgtcgaggagcgcatgtatgcggccggccgcatccccggttcgttcttccgtcgcgagggccgaccctccaccgacgcgatcctgacctgccggctcatcgaccgcccgctgcgcccgtcgtttgtcgacgggctgcgcaacgagatccaaatcgtggtgacgattctcagcctggatccgggcgatctctacgacgtattggcgatcaacgcggcgtcggcgtccacccagctgggcggtctgccgttctccgggcccatcggcggtgtgcgggtggcgctcatcgacggcacctgggtcggcttccccaccgtcgaccagatcgagcgcgccgtgttcgacatggtcgtggccggccggatcgtcgagggtgatgttgccatcatgatggtcgaagccgaggccaccgaaaacgtcgtcgagctcgtcgaaggtggtgcccaagcgccgacggaaagcgtggtggccgcgggcctggaggcggccaagccgtttatcgccgcgctgtgcaccgcgcagcaggagcttgccgatgccgctggaaagtcgggcaaaccgaccgtcgacttcccggtgttccctgactacggcgaagacgtgtactactcggtgtcctcggtggccaccgacgagttggccgccgcgttgaccatcggcggtaaagccgagcgcgaccagcgcatcgacgaaatcaagacccaggttgtgcagcggctcgccgacacctacgagggtcgcgaaaaggaggtcggcgccgcgttgcgtgccctgaccaaaaagctggttcggcagcgcatcctcaccgaccatttccgtatcgacggccgcggcatcaccgacattcgcgcattgtcggccgaggtggccgtggttccgcgcgcgcacggcagcgcgctgttcgaacgcggcgaaacccagatcctgggtgtgaccacactcgacatgatcaagatggcccagcagatcgactcgttggggccggagacatcgaagcggtacatgcaccactacaacttcccgccgttctccaccggcgagaccggtcgggtcggttcgcccaagcggcgtgagatcgggcacggcgcactggccgagcgggccctggtgccggtgttgccgagcgtcgaggaattcccgtatgccattcgccaggtgtcggaggctctgggctccaacgggtcgacctcgatggggtcggtgtgcgcgtcgacgctggcgctgctcaacgccggggtgccgctcaaggcgccggtggccggcatcgcgatgggcctggtctccgacgacattcaagtagaaggggcggtcgacggcgttgtggagcgtcgcttcgtcaccctcaccgacatcctcggcgccgaagacgcgttcggtgacatggacttcaaggtcgccgggaccaaggacttcgtcaccgcgctgcagctggacaccaagctcgacgggatcccttcgcaggtgcttgccggagcactcgagcaggccaaggacgcccgcctcacgatcttggaggtgatggctgaggccatcgatagacccgacgaaatgagtccctacgccccgcgggtgaccaccatcaaggttccggtggacaagatcggggaggtcatcggacccaagggcaaggtcatcaacgccatcaccgaggagaccggcgcgcagatctccatcgaagacgacggcaccgtgttcgtcggcgccaccgacgggccatcggcacaggccgcgatcgacaagatcaacgccatcgccaacccgcagctgccgacggtgggcgaacggttcctcggaaccgtggtcaagaccaccgatttcggtgcctttgtatcgttgctgcctggccgcgacggtctggtgcacatttccaaactcggcaagggcaagcgcatcgcgaaggtcgaggacgttgtcaatgtcggtgacaagctgcgggtggagatcgccgacatcgacaaacggggcaagatctccctgatcctggtcgccgacgaggacagcaccgccgccgctaccgatgccgcgacggtcaccagctga

SEQ ID NO: 107 - DNA, 897 bp, Mycobacterium tuberculosis
atgagcgcaaccggccccggaatcgtggttatcgacaagcccgcgggaatgaccagccatgacgtggtggggcggtgccgccgcatcttcgccacccggcgggtcggccacgcgggcaccctggacccgatggccaccggggtgttggtgatcggcatcgaacgcgccaccaagatcctcggtctgctgacggcggcccccaagtcgtatgccgccaccatccgcttgggtcagaccacttccaccgaggacgccgaaggtcaagtgctgcagtcggttccggctaagcacctgaccatcgaggcgatcgacgccgcgatggagcggctgcgcggtgagatccggcaggtgccgtcgtcggtcagcgcgatcaaggtcggtggccgacgcgcctatcggttggcccgccaggggcgctccgtgcaattggaagcccggccgatccgcatcgaccggttcgagctgctggccgcacgccggcgcgaccagctcatcgatatcgatgtggagatcgactgctcctcgggaacctacatccgcgcgttggcacgcgacctcggcgacgcgcttggggtgggaggccatgtgacggcgttgcggcgcacccgcgtcggccgcttcgagctggaccaggcgagatcgctcgacgatctcgcggagcgccccgcgctgagcctgagcctcgatgaggcctgcctgctgatgtttgcgcgccgcgacctgaccgccgcggaggccagcgcggccgccaacggccggtccctgccggcggtcggtatcgacggcgtgtacgcggcctgtgacgccgacggccgggttatcgcgctgctgcgtgacgagggttcgcggaccaggtcggtggcggtgctccgcccggcgacgatgcaccccgggtag

SEQ ID NO: 108 - DNA, 1689 bp, Mycobacterium tuberculosis
gtgccactgaccgtggccgatatcgatcggtggaacgcgcaagcggtccgggaggtgtttcacgcggccagtgcccgagcggaggtgacgttcgaggcgtcgcgtcagttggccgcgctgtcgatttttgcgaactcgggtggcaagaccgctgaggcggcggcacaccacaacgcgggcattcgccgagacctcgacgcccacggcaacgaggcgttggcggttgcccgggcggccgacagggccgccgacgggattgtgaaggttcagtccgagctggccgcactacgccatgccgccgcggccgccgagctgacgatcgatgcgctgatcaaccgggtggtgccgatccccgggctgcgatccaccgaggcgcagtgggcgcggacgctggccaagcaaacggagctgcaggcggagctggatgcgattatggccgaggccaatgccgtcgacgaggagctggcctcagcggtcaatatggccgacggtgacgcgcccatcccggccgattccggcccgccggtcggtcccgaggggctgaccccgacccagctcgccagcgatgccaacgaggagcggctgcgcgaggagcgcgcccgcctgcaggcccacctcgagcggttacaggcggagtatgaccaactgagtgtgcgggccgcccgtgactaccacaacggcatcctcgacggtgacgcggtgggccgactggcagcgcttaccgacgagctgagcgccgccaggggccggctgggtgagctcgatgccgtcgacgaggcgttgagccgagcacccgagacctacctgacccagctgcagattcccgaggacccaaatcagcaggtgctggcggccgtggccgtcggtaatcccgacaccgccgccaatgtgtcggtgacggttcccggcgtcgggtccaccacccggggcgccctgcccggcatggtgaccgaagcccgcgacctgcggtcggaggtaatccggcaactcaatgctgccggcaagcccgcatcggttgccaccatcgcctggatgggctaccacccgcccccgaacccactcgacaccggcagtgcgggcgatctgtggcagaccatgaccgatgggcaggcacacgcgggcgcggccgatctgtcgcggtatttgcagcaggtgcgcgccaataaccccagtggccacctgaccgtgttggggcactcgtatgggtcgctgacggcgtcgctggcgttgcaggacctcgatgcccagagcgcccatccggtcaacgacgtcgtgttttacggctcacccggcttggagctgtacagcccggcgcagctcgggctcgatcacgggcacgcttatgtcatgcaggccccccacgacctcatcaccaatctggtggcgccgttggcgccgctgcacggatggggcctggacccctatctgacccccgggttcacggagctgtcgtcacaggcgggttttgatccgggcgggatctggcgtgacggagtgtatgcccacggggactacccgcggtccttcctcgatgccgccggccagccgcagctgcggatgtccggctataacctggcggcgatcgccgccgggctgcccgacaacacggtgggcccgccgctgcttccgccaattctgggtggcggcatgccggcagcgcccggcccagcactgagagggggacgttga

SEQ ID NO: 109 - DNA, 1812 bp, Mycobacterium tuberculosis
atggtaactaaaacaacattagcctcagccacctcaggtttgctgctgcttgcggtcgtcgccatgtcgggctgcaccccgcgtccccaagggcccggtccggcggccgaaaagttcttcgccgcgctggccatcggtgacaccgcctccgccgcccagctcagcgacaaccccaacgaggcgcgcgaagcgctgaacgcggcctgggcggggctgcaggccgcccacctggatgcgcaggttctcagcgccaagtacgccgaggacaccggtacggtcgcttatcgcttcagctggcatctgcccaaggaccgaatctggacctatgacggccagctgaagatggcccgcgacgaagggcgttggcacgttcgctggaccaccagcgggttgcatcccaagctaggcgaacatcaaacgttcgcgctacgagccgacccgccgcggcgcgcctcggtgaacgaagtcggcggcaccgatgtgctggtgccgggctatctgtatcactactcgctggacgccggccaggccggccgcgagctcttcggcacggcacacgcggtggtgggcgcgctgcaccccttcgacgacacgctcaatgatccgcagctgctggccgaacaggccagctcgtcgacccagccgttggacctggtcacgttgcacgccgacgacagcaaccgggtggccgcggcgatcgggcagctgcctggcgtggtgatcacaccgcaggccgagctgctcccgaccgacaagcacttcgcgccggcggtcctcaacgatgtcaagaaggccgtcgtcgatgaactcgacggcaaggcgggttggcgggtggtgagcgtcaaccaaaatggcgtcgacgtctcggtgctgcacgaggtcgccccatcacctgcgtcgtcggtttcgatcacgttggatcgggtcgtgcaaaacgccgcgcaacacgcggtgaacacccggggcggcaaggcgatgatcgtcgtgatcaagccgtcgaccggcgagatcctggcgatcgcgcagaacgccggggccgatgcggacggtccggtcgcgaccaccggtctatatccacccgggtcgacattcaagatgatcaccgccggtgcggccgtcgagcgtgacctggctacccctgagacgctgctgggttgccccggggagatcgacatcgggcatcgcaccattcccaactacggtggctttgatctgggcgtggtgccgatgtcacgcgcgtttgccagttcctgcaacaccaccttcgccgagctgagcagcaggctgcctccccgcggtctgactcaggcggcccggcggtacgggatcgggcttgactaccaggtggacggcatcaccacggtgaccggttcggtgccgccgacggtggacctggccgaacgcaccgaggacggtttcggccagggcaaggtgctggccagcccgttcggcatggccttggtggcggcgacggtagccgccgggaagaccccggttccacagctgatcgccggccggccgacggccgtcgaaggcgatgccacaccgatcagccagaagatgatcgacgcgctgcggcccatgatgcggttggtggtgaccaatggcaccgccaaggagatcgctggctgtggcgaggtgttcggtaagaccggcgaagccgaattcccgggcggatcgcattcctggttcgccgggtaccgtggcgatctggcatttgcgtcgctgatcgtcgggggcggtagctcggaatacgcggtgcggatgaccaaggtgatgttcgaatcgctgccgccggggtacctggcgtag

SEQ ID NO: 110 - DNA, 1164 bp, Mycobacterium tuberculosis
gtgactgtaggcttgggcatgccgcagcccccggcacccacgctcgctccccggcgcgccacccgtcagctgatggtcggcaacgtcggcgtgggcagtgaccatccggtctcggtgcaatcgatgtgcaccaccaaaacccacgacgtcaactcgacattgcaacaaatcgccgagctgaccgcggccggatgcgacatcgtgcgggtggcctgcccgcgccaggaggacgccgacgcgctggccgagatcgcccggcacagccagatcccggtagtcgcggacatacatttccagccgcgctacatattcgccgccatcgacgctggatgtgccgcggtgcgggtcaacccgggcaacatcaaggagtttgacggccgggtgggtgaggtcgccaaggcggcgggtgcggccgggatcccgatccgaatcggtgtcaacgccggttcgctggacaaacggttcatggagaagtatggcaaagccacgcccgaggcgctggttgagtcggcgctgtgggaggcttcgcttttcgaggagcatggcttcggtgacatcaagatcagcgtcaagcacaacgacccggtggtgatggtcgccgcctacgagctgcttgctgcacggtgcgactacccactgcacctcggtgtcaccgaggccggccctgctttccagggcaccatcaagtccgcggttgccttcggcgcgttgctgtcgcggggcataggcgacaccatccgggtgtcgttgtcggccccgccggtcgaggaagtcaaggtgggcaatcaggttctcgagtcgttgaacctgcggccgcgttcgctcgagatcgtgtcttgcccgtcgtgcggtcgcgcgcaagtcgacgtctacaccctggccaacgaggtaaccgccggcctggatggtctcgatgtgccgttgcgggtggccgtgatggggtgtgtcgtcaatggtccgggtgaagcacgtgaggccgacctgggcgtggcgtccggcaacggcaaaggtcagatctttgtacggggcgaagtgatcaagaccgtgcccgaagcacagatcgtcgagacgctgatcgaggaggcgatgcggctggccgccgaaatgggcgagcaagatccgggcgcgacaccgagcggttcgcctattgtgaccgtaagctga

SEQ ID NO: 111 - DNA, 1215 bp, Mycobacterium tuberculosis
atgatgtttgttaccggcattgtgctgttcgcgctcgcgatcctgatttcggtggccctgcacgaatgtggtcacatgtgggtcgcgcgccgcaccgggatgaaggtacgtcgctatttcgtcggctttggccccacgttgtggtcgacccggcgcggcgagaccgaatacggtgtcaaagccgttccgctgggcggcttctgtgacatcgccggcatgaccccggtcgaggaactcgaccccgacgaacgtgaccgtgcgatgtacaagcaggccacctggaagcgggtcgcagtgttattcgccgggcccggaatgaacctcgctatctgcctggtgctgatctatgccatcgcgctggtctgggggctgcctaacctgcatccgccaaccagggccgtaatcggcgaaactggctgcgttgcacaggaagtgagccagggcaagctcgagcagtgcaccgggcccggtccggcggcgctggccggaattcgctccggtgacgtcgtggtcaaggtcggtgacaccccggtgtccagtttcgacgagatggccgccgcggtgcgcaagtcacacggcagcgtcccgatcgttgtcgagcgtgacggcaccgcgattgttacctacgtggacatcgaatccacccaacgctggatccctaacgggcagggcggtgagctccagccggcaacggtcggtgcgattggggtgggcgccgcccgggtcgggcctgtgcgctacggcgtgttctccgccatgccggccacattcgcggtcaccggcgacctgaccgtggaggtgggcaaggcgctggccgccctcccgaccaaggtaggtgcgctggtgcgggcgatcggcggcgggcagcgtgacccgcagacgccgataagtgtggtgggcgccagcatcatcggcggcgacaccgtcgaccatgggctgtgggtggcgttctggttcttcttggcccagctgaacctcatcctggctgcgatcaacctgctgccgttgctgccgttcgatggcggccatattgccgtcgcggtgttcgagaggatccgcaacatggtccggtcggctcgtggcaaggtggcggccgcaccggtgaattacctcaaactcttgccggcgacctatgtggtcttggttcttgtcgtcgggtacatgctcttgaccgtcaccgccgacctggtcaacccgattaggcttttccagtag

SEQ ID NO: 112 - DNA, 1311 bp, Mycobacterium tuberculosis
gtggctaccggtggacgcgtcgtgatccggcggcgcggtgacaacgaggtggtggcgcacaatgatgaggtgaccaactcgaccgacgggcgcgctgacggccggttgcgggtggtggtgctgggcagtaccggctcgatcggcacccaggcgcttcaggtcatcgccgacaatccggaccgtttcgaggtagtcgggctggccgctggcggcgcccatctggacacgttgctgcgacaacgtgcgcagaccggggtgaccaatattgccgtcgctgacgagcacgcggcgcagcgggtcggcgacatcccctaccacggatccgacgccgccacccggctggtcgagcagaccgaggccgacgtcgtcctcaatgcgctggtcggcgcgttgggcctgcgaccgacgttggccgcgctcaagacgggtgcccggctggcgctggccaacaaggaatcgctggtcgccggtggttcgctggtgctgcgggcggcgcggcccggtcagatcgtgccggtcgactccgaacactccgcgctggcccagtgcctgcgcggcggcactcccgacgaggtcgccaagctggtgctgacggcctcgggagggccgtttcggggctggtccgcggccgacctcgagcatgtcacccccgagcaggctggcgcgcatcctacgtggtcgatgggcccgatgaacacgctgaattcggcgtcgctggtcaacaagggacttgaggtcatcgaaacccacctgctgttcggcatcccctacgaccgcatcgatgtcgtggtgcacccccagtcgatcatccattcgatggtcaccttcatcgacggttcgacgatcgcccaggccagtcccccggacatgaagctaccgatttcgttagcgctgggctggccgcgtcgggtcagcggcgccgctgctgcctgtgatttccataccgcgtcgagctgggagttcgagccgttggacaccgacgtcttccccgcggtcgagttggcccggcaggccggcgtagccggtggctgcatgaccgcggtttacaatgcggcgaacgaagaagcagcagcggcgttccttgctggccggatcggcttcccggccatcgtcggcatcatcgccgacgtgttgcacgctgccgaccaatgggccgtcgaacccgctaccgtggatgacgtactcgacgcgcagcgctgggcccgcgagcgagcgcagcgcgcggtatctggtatggcttcggtggcgatcgcaagcacggcgaagccgggcgcagcgggtcgacacgcatcgacgttagaaaggtcctga

SEQ ID NO: 113 - DNA, 3870 bp, Mycobacterium tuberculosis
gtgggtgcagggagtcggtttccgctggtggacccgctgccgagcgttggagctcggcctgaccggttacgcggccaaccacgccgacggacgcgtgctggtggtcgcccagggtccgcgcgctgcgtgccagaagctgctgcagctgctgcagggcgacacgacaccgggccgcgtcgccaaagtcgtcgccgactggtcgcagtcgacggagcagatcaccgggttcagcgagcggtaatctggcccctcgtgtacctcaagagtctgacgttgaagggcttcaagtccttcgccgcgccgacgactttacgcttcgagccgggcattacggccgtcgttgggcccaacggctccggcaaatccaatgtggtcgatgccctggcgtgggtgatgggggagcagggggcaaagacgctgcgcggcggcaagatggaagacgtcatcttcgccggcacctcgtcgcgtgcgccgctgggccgcgccgaagtcaccgttagcatcgacaactccgacaacgcactgcctatcgaatacaccgaggtgtcgatcacccgaagaatgtttcgcgacggtgccagcgaatacgaaatcaacggcagcagttgccgtttgatggatgtgcaggagttgctgagcgactccggcatcggccgtgagatgcatgtgattgttgggcaagggaagctcgaggagatcttgcagtcgcggcctgaggatcggcgggcgttcatcgaggaagccgccggtgtgctcaagcatcgcaagcgcaaggaaaaagctctgcgcaaactcgacacgatggcggcgaacctggcccggctcaccgatctgaccaccgagctccggcgtcaactcaaaccgctgggccggcaggccgaggcggcccagcgtgccgcggccatccaagccgatctgcgcgacgcccggctgcgcctggcggccgacgacttggtaagccgcagagccgaacgggaagcggtctttcaggccgaggctgcgatgcgccgcgagcatgacgaggccgccgcccggctggcggtggcatccgaggagctggccgcgcatgagtccgcggtcgccgaactctcgacgcgggccgagtcgatccagcacacttggttcgggctgtctgcgctggccgaacgggtggacgctacggtgcgcatcgccagcgaacgcgcccatcatctcgatatcgagccggtagcggtcagcgacaccgaccccagaaagcccgaggagctagaagccgaggcccagcaggtggccgtcgccgagcaacaactgttagcggagctggacgcggcgcgtgcccgactcgatgctgcccgtgcagagctggccgaccgggagcgccgcgccgccgaggccgaccgggcacacctggcggcggtccgggaggaggcggaccgccgtgagggactggcgcggctggctggccaggtggagaccatgcgggcgcgtgtcgaatcgatcgatgagagcgtggcacggttgtccgagcggatcgaggatgccgcaatgcgcgcccagcagacccgagccgagttcgaaaccgtgcagggccgcatcggtgaactggatcaaggcgaggtcggcctggatgagcaccacgagcgtactgtggccgcgttgcggttggccgacgaacgcgtcgccgagctgcaatccgccgaacgcgccgccgaacgccaggtggcatcgctacgggctcgcatcgatgcgctcgcagtggggctacagcgcaaggacggcgcggcgtggctggcgcacaatcgcagtggcgcagggcttttcggttcgatcgcccaattggtgaaggtacgttccggctatgaagcggcactggccgcggcgctcgggccggcggccgacgcacttgcggtggacggcctgactgccgcgggtagtgccgtcagcgcactcaaacaagccgacggcggtcgcgcggtcctcgtgctgagtgactggccggccccgcaagccccccaatccgcctcgggggagatgctgcctagcggcgcccagtgggccctagacctggtcgagtctccaccgcagttggttggcgcgatgatcgccatgctttcgggtgtcgcggtggtcaacgacctgactgaggcaatgggcctggtcgagattcgtccggagctacgcgcggtcaccgttgacggtgatctggtgggcgccggctgggtcagcggcggatcggaccgcaagctgtccaccttggaggtcacctccgagatcgacaaggccaggagtgagctggccgctgccgaggcgctggcggcgcaattgaatgcggccctggccggtgcgctgaccgagcagtccgcccgccaggacgcggccgagcaagccttggccgcgcttaacgaatccgacacggccatctcggcgatgtacgagcagctgggccgcctcgggcaggaggcccgcgcggcggaagaagagtggaaccggttgctgcagcagcgtacggaacaggaagccgtgcgcacacagactctcgacgacgtcatacaacttgagacccagctgcgtaaggcccaggagacccaacgggtgcaggtggcccaaccgatcgaccgccaggcgatcagtgccgctgccgatcgcgcccgcggtgtcgaagtggaagcccggctggcggtgcgcaccgccgaggaacgcgccaacgcggttcgcgggcgggccgattcgctgcgccgtgcggctgcggcggaacgtgaggcgcgggtgcgggctcagcaagcacgcgccgcaagactgcatgcggccgcggtggccgcagcggtcgccgactgcggacggctgctggccgggcggttgcaccgggcggtggacggggcgtcgcaactgcgcgacgcgtcggccgcgcaacgtcagcagcggttagcggcgatggccgcggtgcgcgacgaggtgaacacgctgagcgcccgagtgggggaactcaccgattcgctgcaccgcgacgagctggctaacgcgcaggcggcgctgcgtatcgagcagcttgagcagatggtgctagagcagttcggaatggcgccggccgacttgatcaccgaatacggtccacatgtggcgctaccaccgaccgagctcgagatggctgagttcgagcaagcccgcgaacgcggcgagcaggtgattgcgcccgcccccatgccgttcgaccgggttacccaggagcgccgggccaaacgcgccgagcgtgcgcttgccgagttgggcagggtcaacccgctggcgctcgaagagtttgctgccttggaggagcgctacaatttcctgtccacccaactcgaggatgtcaaggctgcccgcaaggatctgctgggcgtcgtcgccgatgttgacgcccgcatcctgcaggtgttcaatgacgcgttcgtagacgtggaacgcgaatttcgcggcgtgttcaccgcattgttccccggtggtgaaggacggctgcggctgaccgagcccgacgacatgctcaccaccggcatcgaggtcgaagcccgcccgccgggcaagaagattacccgactgtctttgctctccggtggcgagaaggcgctgaccgcggtggcgatgctggtcgcgatctttcgtgcccgtccatcgccgttctacatcatggacgaggtggaggccgccctcgacgacgtgaacctgcgccgactgctcagcctgttcgaacagctgcgagagcagtcgcagatcatcatcatcacccaccagaagccgacgatggaggtcgcggacgcactgtacggcgtaaccatgcagaacgacggcatcaccgcggtcatctcgcagcgcatgcgcggtcagcaggtggatcagctggttaccaattcctcgtag

SEQ ID NO: 114 - DNA, 723 bp, Mycobacterium tuberculosis
atgatccggtcacgacaacccctgctcgacgcactcggtgtggacctcccggacgagctgctctcactggcgttgacccaccgcagctacgcctacgagaacggcgggctgccgaccaacgagcgtttggagtttctcggcgatgccgtgctagggctgaccatcaccgacgcgctgttccatcgtcatcctgatcggtcggagggggatctggccaaactgcgggccagcgtagtcaacacccaggccctggccgacgtcgcacgccgcctctgtgcggaaggcctcggtgttcacgtgctattgggtcgcggcgaggcgaacaccggcggggccgacaagtccagcattctggccgacggtatggaatcgctgctgggcgcgatctacctgcaacacggtatggagaaggcccgtgaggtgatcctgcggctgtttggcccgttgctggacgccgcgccgaccctgggtgcgggattggattggaagaccagcttgcaggagctgactgcagcgcgagggctgggtgcgccgtcatacctggtcacctccaccggcccggaccacgataaggaattcaccgcggtggttgtcgtgatggacagcgaatacggttcaggagtgggccggtccaaaaaagaagccgagcaaaaagccgcggcggccgcttggaaagccctggaagtgctcgacaacgccatgccgggcaaaacctccgcctaa

SEQ ID NO: 115 - DNA, 5484 bp, Mycobacterium tuberculosis
atgacaagtctggcggagcgcgcggcgcaactgtcgccgaacgcgcgagcggccctggcgcgcgagctcgtccgtgcgggtacgaccttcccgaccgacatctgcgagccggtggcggtggtgggcatcggctgtcgctttccggggaatgtgactgggccagagagcttttggcagctactggccgacggtgtggacacaatcgagcaggtgccgcctgatcggtgggatgcggacgcgttctacgatcccgatccttcggcgtcgggtcggatgacgacgaaatggggtggtttcgtttccgatgtcgacgcgttcgacgccgactttttcggaatcactcctcgggaagccgtggcgatggacccgcagcatcggatgctgctcgaggttgcctgggaagcgttggagcacgcgggtattccgccggattccttgagcggcactcgaaccggcgtgatgatgggtctgtcgtcgtgggactacacgatcgtcaatatcgagcgcagagccgacatcgacgcgtacctgagcaccggaaccccgcactgtgccgcggtggggcggatcgcgtatctgttgggattgcgtggtccggccgtcgccgtagataccgcttgttcgtcgtcgctggtggcaattcacttggcgtgtcagagccttcgcctgcgtgaaaccgacgtggcattggcgggcggggtgcagctcaccttgtcaccgttcaccgccatcgcgctgtccaagtggtcggcgctgtcaccgaccggccgatgcaacagcttcgacgccaacgcggatggattcgtgcgcggcgagggctgcggcgtggtggtgctcaagcggttggccgacgcggtgcgcgaccaggaccgggtgcttgcggtggtccgcggttcggcaactaactccgatggtcggtccaacggcatgaccgcaccgaacgcgctggcgcagcgtgacgtgatcacatccgccctcaagcttgcggatgttacccctgacagcgtgaactatgtcgaaacacacggcaccggaacggtgttgggggaccccatcgagttcgagtcgctggcggccacttatggcctgggtaaaggccagggcgagagcccgtgcgcattggggtcggtcaagaccaacatcggccacctggaggcggccgccggtgtggctggattcatcaaggcggtgctggcggtgcaacgtgggcacattccccgcaacttgcacttcacccggtggaacccggccatcgacgcgtcggcgacgcggctgttcgtgccgaccgaaagcgccccgtggccggcggctgccggtccacgcagggctgcggtgtcatcgttcggcctcagcgggaccaacgcgcacgtggtggtcgagcaggcacccgacaccgcagtagccgcagccggcggcatgccgtatgtttcggcgctgaacgtctccggcaagacggccgcgcgggtggcgtcggcggcggcggtgctggccgactggatgtcggggccgggcgcggcggcaccactggccgacgtggcacacacgttgaaccggcaccgggcccggcacgccaagttcgccaccgtcatcgcgcgtgaccgcgccgaggcgatcgcggggttgcgagcgctggcggccggacaaccacgcgttggggtggtggattgcgaccagcatgccggtgggcctggccgggtttttgtgtattcgggtcagggctcgcagtgggcgtcgatgggccagcagttgctggccaacgaaccggcgttcgccaaggcggtagccgagctggatccgatattcgttgaccaggttggcttttcgctgcagcaaacgcttatcgacggcgacgaggtggtgggcatcgaccgcatccagccggtgctggtcgggatgcagttggcgctgaccgagttatggcggtcctatggggtgattccagatgccgtgatcgggcactcgatgggtgaggtgtcggcggcagtggtggccggcgcgttgacgcccgagcagggcttgcgggtcatcaccacccggtcgcggttgatggcgcggctgtcggggcagggagcgatggcgctgctcgagctggatgccgacgccgccgaggcgctgattgccggctatccgcaggtgacgctggcggtgcatgcgtcaccgcgccagacggtgatcgccgggccgcccgagcaggtggacacggtgatcgcggcggtagcgacgcaaaaccggttggcgcgccgcgtcgaagtcgacgtggcctcccatcacccgatcatcgatcccatactgcccgagttgcgaagcgcgttagcggatttgactccgcagccgccgagcatcccgatcatttccactacgtacgaaagcgcgcagccggtggcggatgccgactattggtcggccaacctgcgcaacccggtgcgattccaccaggccgtcaccgccgccggtgtcgaccacaacaccttcatcgaaatcagccctcaccccgtgctcacgcacgcactcaccgacaccctggatccggacggcagccatacagtcatgtcgacgatgaaccgcgaactggaccagacgctgtatttccacgcccaactcgccgcggtcggtgtggctgcgtccgagcacaccaccggtcgccttgtcgacctgccccccacaccgtggcaccatcagcgattctgggtcacggatcgttcggcgatgtccgagctggccgcgacccacccgctcctgggcgcgcacatcgagatgccgcgcaacggagaccatgtctggcagaccgatgtcggcaccgaggtctgtccctggttggcagaccacaaggtgttcggtcaacccatcatgccggccgcggggttcgccgagatcgccttggcggcggccagcgaagccctcggcacagccgccgacgccgtcgcacccaacatcgtgatcaaccagttcgaggtggagcagatgctgcccctcgacggccacacgccgctaacgacgcagttaattcgcggcggggacagccagattcgggtcgagatctattcccgcacgcgtggcggagagttctgccgacacgccacggccaaggttgaacaatcgccgcgcgaatgtgcgcacgcgcacccggaagcccaaggtcccgccaccgggacaacagtgtcgccggccgatttttatgccctgctccgccaaaccggccaacaccatggtccggcgttcgcggccttaagccggatcgtgcgcctggccgatggttccgcggaaaccgagatcagcattcccgacgaggcgccgcgccatcccgggtatcggctgcaccccgtggtattggatgcggcattgcaaagcgtgggtgccgcgatacccgacggcgagatcgcggggtcggcggaagccagctatctgccagtgtcgttcgagaccatccgggtgtaccgcgacatcggtcggcacgtcaggtgtcgtgcccacctgacaaacctcgacggcggcaccggaaagatgggcaggatcgtcctaatcaacgacgccggccacatagcggccgaagtggacggcatctatctgcgtcgtgtcgaacgccgtgcggtacccctgccactagagcagaagatcttcgatgccgaatggaccgaaagcccgatcgcagccgtgccggctccggagccagctgccgagacgacgcggggaagttggctggtactcgccgatgcaacggtggatgcgccaggcaaggcccaggccaagtcgatggccgacgacttcgtgcagcagtggcgctcaccgatgcggcgggtgcacaccgccgatatccacgacgaatcggcggtgctggccgcatttgcagaaacggcaggcgatcccgagcacccgccggttggcgtggtggtgttcgtcggcggtgcctcgagtcgactggacgacgagctggcggcggcgcgcgacacggtgtggtcgatcaccacggtggttcgtgcggtcgtcggcacgtggcacggccgatcaccgcggctatggctggtcaccgggggcggactttccgttgccgacgacgagccgggaacacccgcggcggcttccttgaaagggctggtgcgggtgctcgccttcgagcacccggacatgcgcaccaccctggtcgatctggacatcacacaagacccgctgaccgcgctgagcgcggaactgcggaatgccgggagtgggtcgcgccatgatgacgtgatcgcgtggcgcggcgagcgcaggttcgtcgaacggctgtcgcgcgccacgatcgatgtatccaaagggcatccggtggtgcgccagggagcgtcgtacgtcgtcaccggcggcctcggcggtctcggcctggtcgtcgctcgttggctggtggaccgcggcgccggccgggtggtgctgggtggccgcagcgatcccactgacgagcagtgcaacgtcctggccgaactgcagacccgcgccgagatcgtggttgtccgtggcgacgtggcatcgccgggggtggcagaaaagctgattgagacggcccgacagtctgggggccaattgcgcggcgtcgtgcacgccgccgcggtcatcgaagacagcctggtgttctctatgagcagggacaacctagaacgggtgtgggcacccaaggccaccggtgcgctgcgcatgcacgaagccaccgctgactgcgagctcgactggtggctcggattctcttccgccgcttcgctattgggttctcccgggcaagcggcctacgcgtgcgccagcgcgtggctggacgcgctggtcggatggcgcagggcatccggcctgccggccgcggtgatcaactggggtccgtggtcggaggtaggcgtcgcccaggccttggtgggcagtgttctcgacacgatcagtgtcgcagaaggcatcgaggctctcgactcattgcttgccgccgaccggatccgcactggagtggctcggctgcgtgccgatcgggccctggtcgcattcccggagatccgcagcatcagctacttcacccaggtggtcgaggagctggactcggcgggtgacctcggcgactggggcgggcccgacgcgcttgccgacctcgacccgggcgaggcgcggcgcgcggtgaccgagcggatgtgtgcgcgcatcgctgcggtgatgggctacactgaccagtcgactgtcgaacccgccgtgcccttggacaagcccctgaccgagctggggctggattctctgatggcggtacgaatacgcaacggcgcgcgggcggatttcggcgtggaaccgccggtagcgctgatactgcaaggcgcgtccttgcatgacctgacggcggacttaatgcgccaactcgggctcaatgatcccgatccggcgctcaacaacgctgacactattcgcgaccgggcgcgccagcgcgcggcagcgcgacacggagccgcgatgcggcgccgacctaaacctgaagtacagggaggataa

SEQ ID NO: 116 - DNA, 4851 bp, Mycobacterium tuberculosis
gtgatttcggcgagatcggctgaggcgttgacggcgcaggcgggtcgacttatggcccacgtgcaggccaacccagggctggatccgatcgatgtggggtgctcgttggccagtcgctcggtgtttgagcaccgagcggtggtggtcggcgcaagccgtgagcaactgattgccgggctggctgggctcgcggcgggcgagccgggtgccggcgtggcggtcggtcagccagggtcggtgggcaagacggtggtcgtgtttcctgggcagggcgcgcagcgcatcgggatgggccgcgagttgtacggcgagttgcccgtgtttgcgcaggcattcgatgcggtggccgacgagttggaccggcatctgcggttgccgctgcgcgacgttatttggggtgccgatgcggatttgcttgacagcaccgaatttgctcagcccgcgttgttcgcggtggaggtggcatcgttcgcggtgttgcgggattggggtgtgcttccggacttcgtcatgggtcactccgttggagagctggcggcggcgcacgcggccggtgtgttgacgttggcggacgcggcgatgctggtggtggcgcggggccggttgatgcaggcgctgccggcaggcggtgcgatggtggcggtggctgccagtgaggacgaggtggagccgctgctgggtgagggtgtggggatcgctgcgatcaacgcgcccgaatcggtggtgatctccggtgcgcaggccgcggcaaatgcgattgcggatcggttcgccgcgcagggtcggcgggtgcaccagttggcggtctcgcatgcgtttcattcgccgttgatggagccgatgctcgaggagttcgcgcgtgtcgcggcccgggtgcaggcacgcgagccccagcttgggctggtgtcgaacgtgacgggcgagttggccggccctgatttcgggtcggcgcagtactgggtggaccacgttcgtcggccggtgcgcttcgcggacagtgcgcgtcatttgcagacccttggggcgacccacttcatcgaggccggcccgggaagtggtttgactggctcgatcgagcagtccttggccccggctgaggcgatggtggtgtcgatgctgggcaaagaccggcccgagctggcctcggcgctcggtgctgccggtcaggtgttcaccaccggtgtgccggtgcagtggtcggcggtgttcgccggctcgggtggacggcgggtgcagctgcccacgtatgcgtttcagcgacggcggttttgggagacgccgggcgcggatgggcccgccgatgcggccgggttgggtctgggcgcgaccgagcatgccttgttgggtgcggtggtcgagcggcccgattctgacgaggtggtgctgaccggccggttgtcgcttgcggatcagccgtggctggccgaccacgtggtgaacggggtggtgctgttccccggggcgggttttgtggagttggtgatccgcgccggtgatgaggtcgggtgcgcgctcatcgaagagttggtgctggccgcaccgttggtgatgcacccgggtgtcggggttcaggtgcaggtggtcgtcggggctgccgatgaatccgggcaccgtgcggtgtcggtgtattcccgcggtgatcaatcccagggttggttgctgaacgccgaaggcatgctgggggtggctgccgctgagacgccgatggatttgtccgtgtggccgcccgagggcgcggagagtgtggatatctcggacggctatgcgcagttggccgagcgcggttatgcctacggccccgcgtttcagggtctggtggcgatctggcggcgggggtcggagctgttcgccgaagttgtagcccccggcgaggccggcgtggccgtcgaccgaatggggatgcatccggcggtgttggacgcggtgctgcatgccctcgggctggccgtcgagaagacccaggcgagcaccgagacgagactgccgttttgctggcgtggggtgtcgctgcatgccggcggcgctggacgggtgcgggcccgcttcgcgtccgcgggcgcggatgcgatttccgtggacgtctgcgacgccactgggctgccggtgttgacggtgcgctcgctggttactcgcccgataaccgcagaacagctgcgcgccgccgtgaccgcggccggcggtgcgtccgatcaggggccgctggaagtggtgtggtcgccgatctcggtggtcagcggcggcgctaacgggtccgccccacctgccccggtgtcttgggcggacttttgcgccggcagtgatggtgacgccagtgtcgtggtgtgggaactcgagtctgccggtggccaagcatcctcggtggtgggctcggtgtatgcggccacccacaccgccctggaggtgttgcagtcctggctcggcgcggatcgggcggccacgttggtggtgttgacccatggtggcgtggggctggctggcgaggacatcagcgacctggccgccgccgcggtgtggggcatggcgcgttccgcgcaggccgaaaatcccggccggatcgtgttgatcgacaccgatgcggcggtggatgcctcggtgctagccggcgtcggggaaccccagctgctggtgcgcggcggcactgtgcacgccccccggctgtccccggccccggcgttgctagcgttaccggcggcagagtcggcgtggcgattggccgccggtggtggcgggaccctggaggatttggtgatccagccctgcccggaggtacaggcaccgctacaggcggggcaggtgcgcgtggcggtggcggccgtcggggtcaacttccgcgatgtggtggccgccctagggatgtatcccggccaggccccaccgctgggtgccgaaggcgccggggtggtgcttgagaccggtcccgaagtgaccgatcttgccgtcggtgacgccgtgatgggattcctgggcggggccggtccgctggcggtggtggatcagcaactggttacccgggtgccgcaaggctggtcgtttgctcaggcagccgctgtgccggtggtgttcttgacggcctggtacgggttggccgatttagccgagatcaaggcgggcgaatcggtgctgatccatgccggtaccggcggtgtgggcatggcggctgtgcagctggctcgccagtggggcgtggaggttttcgtcaccgccagccgtggcaagtgggacacgctgcgcgccatggggtttgacgacgaccatatcggcgattcccgcacatgcgagttcgaggagaagttcctggcggtcaccgagggccgcggggttgatgtggtgctcgactcgctggccggtgagttcgtggatgcgtcgctgcgcttactggtccgcggtgggcgtttcctcgagatgggcaagacggatatccgcgatgcgcaggagatcgccgctaattatcccggcgtgcagtatcgggcgttcgacctgtcggaggccggcccggcacgcatgcaggagatgttggccgaggtgcgggagctgttcgacacccgggagctgcaccggctaccggtcaccacgtgggatgtgcgctgcgccccggcggccttccggttcatgagccaggcccgccatatcggcaaggttgtcttaaccatgccctcggcgttggccgaccggcttgccgacggcacggtggtgatcaccggtgccaccggggcggttggtggggtgttggcccgccacctggttggcgcctatggggtgcgtcatctggtgttggccagtcggcggggcgatcgcgcggagggagcggccgaattggccgccgacttgacggaggccggcgccaaggtgcaggtggtggcctgtgacgtggccgatcgcgctgcggtagcggggttgtttgcccagctgtcgcgggagtacccgccggtgcgcggggtgattcatgccgccggcgtgctcgatgacgcagtgatcacctcgttgacaccggaccgcatcgatacggtgttgcgggccaaggtggacgcggcgtggaacctgcaccaggccaccagtgacctggatttgtcgatgtttgcgctgtgctcatcgatcgcggccacggtcggctcgccggggcagggcaactactcggcggcaaacgcgtttctggacgggttggccgctcaccggcaggccgcagggttggccgggatatcactggcgtggggtttgtgggaacagcctggcggcatgaccgcgcatttgagcagccgagatctggcccgcatgagccgcagcgggctggctccgatgagccctgccgaagcggtggaattgtttgacgctgcgctggccatcgatcaccctctggcggtggccacgctcttggaccgggctgcactagacgcccgggcccaggccggtgcgttgccggcgctgttcagcgggctcgcgcgccgcccacgccgacgccaaatcgacgacaccggtgacgccacctcgtcgaagtcggcgctggctcaacgcctacacgggctggccgcggacgaacaactcgagctgctagtggggctggtgtgtctgcaggcagcggcagtgctgggtaggccctccgccgaggacgtcgaccccgacaccgaattcggcgacctcggtttcgactcattaacggctgtggagttacgcaaccgcctcaaaaccgccaccggactgacgctgccacctaccgtgattttcgatcatcccactcccactgcggtcgccgagtatgtcgcccagcaaatgtctggcagccgcccaacggaatccggtgatccgacgtcgcaggttgtcgaacccgccgccgcggaagtatcggtccatgcctag

SEQ ID NO: 117 - DNA, 2076 bp, Mycobacterium tuberculosis
gtgagctccccagacgccgatcagaccgctcccgaggtgttgcggcagtggcaggcactggccgaggaggtgcgtgagcaccagttccgttattacgtgcgggacgcgccgatcatcagcgacgcggaattcgacgagctgctgcgccgtctggaagccctcgaggagcagcatcccgagctgcgcacgcccgattcgccgacccagctggtcggcggtgccggcttcgccacggatttcgagcccgtcgaccatctcgaacgaatgctcagcctcgacaacgcgttcaccgccgacgaactcgccgcctgggccggccgcatccatgccgaggtcggagacgccgcacattacctgtgtgagctcaagatcgacggcgtcgcgctgtctttggtctaccgcgagggacggctgacccgggcctccacccgcggcgacgggcgcaccggcgaggacgtcaccctgaacgcccggaccatcgccgacgttcccgaacggctcacccccggcgacgactacccggtgcccgaggtcctcgaggtccgcggcgaggtcttcttccggctggacgacttccaggcgctcaacgccagcctcgtcgaggagggcaaggcgccgttcgccaacccccgcaacagcgcggcgggatcgctgcgccagaaagacccggcggtcaccgcgcgccgccggctgcggatgatctgccacgggctgggccacgtggagggctttcgcccggccaccctgcatcaggcatacctggcgttgcgggcatggggactgccggtttccgaacacaccaccctggcaaccgacctggccggtgtgcgcgagcgcatcgactactggggcgagcaccgccacgaggtggaccacgaaatcgacggcgtggtggtcaaagtcgacgaggtggcgttgcagcgcaggctgggttccacgtcgcgggcgccgcgctgggccatcgcctacaagtacccgcccgaggaagcgcagaccaagctgctcgacatccgggtgaacgtcggccgcaccgggcggatcacgccgtttgcgttcatgacgccggtgaaggtggccgggtcgacggtgggacaggccaccctgcacaacgcctcggagatcaagcgcaagggcgtgctgatcggcgacaccgtggtgatccgcaaggccggcgacgtgatccccgaggtgctgggacccgtcgtcgaactgcgcgatggctccgaacgcgaattcatcatgcccaccacctgcccggagtgcggttcgccgttggcgccggagaaggaaggcgacgccgacatccgttgccccaacgcccgcggctgcccggggcaactgcgggagcgggttttccacgtcgccagccgcaacggcctagacatcgaggtgctcggttacgaggcgggtgtggcgctcttgcaggcgaaggtgatcgccgacgagggcgagctgttcgcgctgaccgagcgggacttgctgcgcaccgacctgttccgaaccaaggcaggcgaactgtcggccaacggcaaacggctgctggtcaacctcgacaaggccaaggcggcaccgctgtggcgggtgctggtggcgctgtccatccgccatgtcgggccgacggcggcccgcgccctggccaccgagttcggcagccttgacgccatcgccgcggcgtccaccgaccagctggccgccgtcgagggggtggggccgaccattgccgccgcggtcaccgagtggttcgccgtcgactggcaccgcgagatcgtcgacaagtggcgggccgccggggtgcgaatggtcgacgagcgtgacgagagtgtgccacgcacgctggccgggctgaccatcgtggtcaccggctcgctgaccggtttctcccgcgacgacgccaaggaggcgatcgtggcccgcggcggcaaggccgccggctcggtgtcgaagaagaccaactatgtcgtcgccggagactcgccgggatccaaatacgacaaggcggtggagttgggggtgccgattctggacgaggatgggttccggagactgctggccgacggacccgcgtcacgaacgtaa

SEQ ID NO: 118 - DNA, 1182 bp, Mycobacterium tuberculosis
atggcctacctggatcacgctgccaccaccccgatgcaccccgccgccatcgaggcgatggcggccgtgcagcgcaccatcggcaatgcgtcgtcgctgcacaccagcgggcgctcggcgcgccggcggatcgaggaggcccgtgagctgatcgcggacaagctaggcgctcgtccgtccgaggtgatcttcaccgcgggcggcaccgaaagcgacaacctggctgtcaaaggtatctattgggcacgccgcgatgcggagccgcaccgccgtcgcatcgtcaccaccgaggtggaacaccacgccgtactggactcggtgaactggctcgtggaacacgaaggcgcccatgtgacctggctgccgaccgccgccgacggctcggtgtcggcaactgcgctgcgcgaggcactgcagagccacgacgacgtcgcgctggtatcggtgatgtgggccaacaacgaggtcggaactattctaccgatcgccgaaatgtcagttgtcgccatggaattcggcgtgccgatgcacagtgatgccattcaggcggtgggacagctcccgcttgacttcggggccagcgggctgtcggcgatgagcgtggccgggcacaaattcggtggcccgccaggagtgggtgcgttgctgctgcgccgcgacgtcacctgcgtgccccttatgcacggcggtgggcaggagcgcgatattcgttccggcacacccgatgtcgccagtgcagttggaatggcgacggccgcgcagatcgcggtggacggactcgaggaaaacagcgcgcggttacggctgctgcgggatcgtctggtcgagggtgtgctggctgagattgacgatgtttgccttaacggcgccgatgacccgatgcggctagcgggtaacgcgcacttcactttccgtggctgcgaaggcgatgcgctgttgatgttgttggacgctaacggaatcgagtgctcaaccggatcggcctgcacggcaggtgtagcgcagccctcgcatgtgttgattgcaatgggcgtcgacgcggccagcgcccgcggatcattgcgtctctcgctggggcacaccagtgttgaggctgatgtcgatgccgcgttggaggtgcttcccggggcggtggcacgtgcacggcgggccgccctagccgccgcgggagcatcccgatga

SEQ ID NO: 119 - DNA, 3333 bp, Mycobacterium tuberculosis
atgaccgacgttgatccgcacgcgacgcggcgggacctggtcccgaatattcccgcggaactgcttgaggctggattcgacaatgtcgaggagatcgggcgcggcggattcggcgtcgtctaccgctgcgtccagccctcgctggaccgcgccgtcgccgtcaaggtattgagcaccgacctggatcgggacaatctcgagcgcttcctgcgcgagcagcgggccatgggccgcctttccgggcacccgcacatcgtgaccgtcttgcaggtgggcgtgttggcgggtgggcggcccttcatcgtgatgccctaccacgccaagaattcgttggagacgctgattcgccggcacgggccgctggactggcgcgagacgctgtcgatcggcgtcaagctcgcgggagcgctggaagccgcgcatcgcgtcggcaccctgcaccgtgacgtgaagccggggaatatcctgctgaccgactacggggaaccgcagctgaccgatttcggaatcgccagaatcgccgggggtttcgagacggcgaccggggtgattgccggttccccggctttcaccgcgccggaagttctcgaaggagcatcgccgacgcccgcctctgacgtgtactccctgggcgcgacgttgttctgtgcgctgaccggccatgccgcctacgagcgccgcagcggtgagcgggtgatcgcccagttcctgcggatcacctcgcagccgatccccgacctgcggaagcagggactgcccgcggacgtggccgccgccatcgaacgggcgatggcccgccatccggcggatcgtcccgcgaccgcggcagacgttggcgaggagcttcgcgacgttcagcgccgcaacggcgtcagcgtcgacgagatgcccctccccgtcgagctgggcgtggaacgccgacgctcgcccgaggcgcacgcggcgcatcggcataccggcggcggcaccccgacggtcccgacgcctccgacacccgcgaccaagtaccggccgtcggtgcccaccggctcgctggtcacccgcagccggctcaccgacatcctgcgcgccggcggacggcgccggctgatcctcatccacgcgccctcgggattcggcaaaagcaccctggcggcgcaatggcgggaagagctctcgcgcgacggcgccgcggtcgcctggctgacaatcgacaacgacgacaacaacgaggtgtggttcttgtcgcacctgctcgagtcgatccggcgggtccggcccacgctggccgagtcgttggggcacgtgctcgaagagcatggggatgacgccggccgctacgtgttgacttcgctgatcgacgaaatccacgaaaacgacgaccggatcgcggtggtgatcgacgactggcatcgggtgtccgacagccgcacccaagctgccctgggtttcctgctggacaacggatgtcaccacctgcagctcatcgtgaccagctggtctcgcgccggtttgccggtgggcaggttgcggatcggcgacgaactagccgagatcgattcggctgctttgcgcttcgataccgacgaggccgccgcgctgctgaacgatgctggtggtctgcgattgccgcgcgcagacgtgcaggcgctgactacctctaccgacgggtgggccgcggcgctgcggctggccgcgctgtcgctgcgcggcgggggcgacgcgacccaactcctgcgcggactttccggcgccagtgacgtgatccacgaattcctgagcgaaaacgtgctggacaccctggaacccgaactgcgcgaattcctactggtggcatcggtcaccgaacgcacgtgcggcgggctggcctcggcgctggccgggatcaccaatgggcgggcgatgctggaagaggccgagcaccgcggcttgttcctgcaacggaccgaagacgacccgaattggtttcgcttccaccaaatgttcgccgactttctccaccgtcgcctcgaacgtggcgggtcgcaccgggtggcggaactgcaccgcagggcatcggcctggttcgccgagaacggctacctgcacgaagccgtcgaccatgcactggccgcgggcgatcccgcgcgcgccgtcgatcttgtcgagcaggatgaaacgaacctgccggagcagtcaaagatgaccacacttctggcaatcgtgcagaaactgccgacgtcgatggtggtttcacgggcccggctccaactcgccatcgcgtgggcgaacattctgctgcaacggccggcgccggccaccggtgccctgaatcgtttcgaaacggcccttggccgggccgagcttcccgaggcgacgcaggcggatctgcgggccgaggcagacgtgttgcgggcggtcgccgaggtgttcgcagaccgggtcgagcgcgtggatgaccttctcgccgaggcaatgtcgagaccggacaccctgcccccgcgagtccccgggaccgccggcaacaccgcggcgttggccgcgatctgccgcttcgagttcgccgaggtatatccactgctggactgggccgcgccctaccaggaaatgatgggaccgttcggcaccgtttatgcgcagtgcttgcgcggcatggcggccaggaatcggctcgacattgtcgctgcgctacagaacttccgaacggcgttcgaggtcggcacggcagtgggggcccactcgcacgcggcgcggcttgcgggttcgctgctcgccgaattgctctacgagaccggcgatctggccggggctggtcgtctcatggacgagagctatctgctgggttccgaggggggtgcagtggactacctggccgccaggtacgtgatcggcgcgcgggtcaaggcggcccagggggatcatgagggtgcggctgatcgcctgtccaccggaggcgatactgccgtccagctggggctgccgcgcctggctgcccgaatcaacaacgagcggatccggctgggcatcgcgctacctgcggcggtggccgccgatttgctggcaccccgcaccatcccccgcgacaatggaatcgccaccatgacagccgaactcgacgaggactccgcggtgcgcctgttgtccgccggcgactccgccgatcgtgaccaagcctgccaacgggccggtgctctcgccgccgccatcgacggtacgcgcagaccgctggcggcgctgcaggcgcaaatacttcatatcgaaacgcttgccgccaccggacgggaatccgatgcgcgaaacgaactggcgccggtagccacgaagtgcgccgaactcgggctgtcacgtctgctggtcgatgcgggactggcctaa

SEQ ID NO: 120 - DNA, 1371 bp, Mycobacterium tuberculosis
atgcgtccctattacatcgccatcgtgggctccgggccgtcggcgttcttcgccgcggcatccttgctgaaggccgccgacacgaccgaggacctcgacatggccgtcgacatgctggagatgttgccgactccctgggggctggtgcgctccggggtcgcgccggatcaccccaagatcaagtcgatcagcaagcaattcgaaaagacggccgaggacccccgcttccgcttcttcggcaatgtggtcgtcggcgaacacgtccagcccggcgagctctccgagcgctacgacgccgtgatctacgccgtcggcgcgcagtccgatcgcatgttgaacatccccggtgaggacctgccgggcagtatcgccgccgtcgatttcgtcggctggtacaacgcacatccacacttcgagcaggtatcacccgatctgtcgggcgcccgggccgtagttatcggcaatggaaacgtcgcgctagacgtggcacggattctgctcaccgatcccgacgtgttggcacgcaccgatatcgccgatcacgctttggaatcgctacgcccacgcggtatccaggaggtggtgatcgtcgggcgccgaggtccgctgcaggccgcgttcaccacgttggagttgcgcgagctggccgacctcgacggggttgacgtggtgatcgatccggcggagctggacggcattaccgacgaggacgcggccgcggtgggcaaggtctgcaagcagaacatcaaggtgctgcgtggctatgcggaccgcgaaccccgcccgggacaccgccgcatggtgttccggttcttgacctctccgatcgagatcaagggcaagcgcaaagtggagcggatcgtgctgggccgcaacgagctggtctccgacggcagcgggcgagtggcggccaaggacaccggcgagcgcgaggagctgccagctcagctggtcgtgcggtcggtcggctaccgcggggtgcccacgcccgggctgccgttcgacgaccagagcgggaccatccccaacgtcggcggccgaatcaacggcagccccaacgaatacgtcgtcgggtggatcaagcgcgggccgaccggggtgatcgggaccaacaagaaggacgcccaagacaccgtcgacaccttgatcaagaatcttggcaacgccaaggagggcgccgagtgcaagagctttccggaagatcatgccgaccaggtggccgactggctagcagcacgccagccgaagctggtcacgtcggcccactggcaggtgatcgacgctttcgagcgggccgccggcgagccgcacgggcgtccccgggtcaagttggccagcctggccgagctgttgcggattgggctcggctga

SEQ ID NO: 121 - DNA, 642 bp, Mycobacterium tuberculosis
atgatggccagcaaccaaaccgctgcgcaacactcgtctgccactctccagcaggctcctcgttcgatcgatgatgctggagggtgccccttgaccatcagtcctatcgcgaactcaccgggcgacaccttcgccgtcacacccgtcgtcgagtacgagccgccgccgcgaaacatcccgccgtgcgggcaatcatcgcacgcagcccggcggccgcacaccccgcagctagctcgccgacaaccaatcaggccgagcggccgggcaccggcagcggtcacctccacggccaagtcaccgcggctgcgtcaagcggggaccttcgccgatgccgcgctacgccgagtgctggaggtcatcgaccgccgccgcccggtgggccagctgcgccccctgctggcacccggcctcgtcgactccgtgctcgcggtgagccgcacggcggccggacaccaacaaggcgcggccatgctgcgccgcatccggctgacaccggccggacccgacaccgcggacaccgccgccgaggtcttcggcacctacagtcgcggggaccggatccatgcgatcgcctgccgggtggaacaacggcccgccggtaacgaaacccgatggctgatggtcgccctgcacatcgggtga

SEQ ID NO: 122 - DNA, 1227 bp, Mycobacterium tuberculosis
gtggaactgctacgtggcgcgttacgcacctacgcttggggatcgcgcaccgctatcgccgaattcaccgggcgtccggtgccggccgctcaccccgaggccgaactatggttcggtgcacacccgggtgatccggcttggctgcagacgccgcatggccaaacctcgttgctcgaagcgttggtcgcggatccggaggggcagctcggctccgcgtcgcgcgcgcgattcggcgatgtgttgccgttcttggtcaaggtgttggcggccgacgagccactatcgttgcaggcccatccgagcgccgagcaggcggttgagggctacctgcgggaagagcgaatgggcattccggtgtcctcacccgtccgcaactaccgcgacaccagtcacaagccagagttattggtggcgctgcagccgttcgaggcgctggccggattccgggaggcggctcgcaccaccgagctgctgcgggcgctggccgtatccgacctcgacccgttcatcgacttgctgagcgaggggtccgatgccgatggtttgcgtgcgctgttcaccacctggattaccgcaccccagcccgacatcgacgtgctggtgcctgccgtgctggacggcgctatccagtacgtcagctccggcgcaacggaatttggcgccgaagccaagacagtgctggaactcggcgaacgttatcccggcgacgccggtgtgctggcggcgttgttgctcaaccgcatcagcttggctcctggggaggcgatcttcctgccggccggcaacctgcacgcctatgtgcgtggtttcggtgtggaagtgatggccaactccgacaacgtgttacgcggtggacttacccctaagcacgtcgatgtgcccgagttgttgcgggtgctggacttcgcccccacgccgaaggctcggctgcggcccccgatccggcgcgaggggctggggctggtctttgagacgcccaccgatgagttcgcggccacgctactggtgctcgacggcgatcacctcggccacgaggtcgacgcgtcgtccggccatgacggtccacagatcttgttatgcaccgagggttcggcgacggtgcacgggaagtgcgggtcgctcacgctacagcgcggcacggccgcctgggtggcggccgacgacggcccgatccggctgaccgccggccaacccgccaagctgttcagggcgaccgtcgggttgtga

SEQ ID NO: 123 - DNA, 1080 bp, Mycobacterium tuberculosis
ttggcaactcaccaagtcgatgcggtggtcctggtcggtggcaagggtacccgactgcggccgttgacgctgtcggcgcccaagccaatgctgcctaccgccggactgccgttcctcacccatctgctgtcgcggatcgccgcagcgggcatcgagcacgtgatcctgggtacgtcctacaaacccgcagtcttcgaagcggagttcggcgacgggtccgcactgggcctacagatcgaatacgtgaccgaggagcatcccttggggactggcggcggcatcgccaacgttgccggcaagctgcgcaacgacaccgcgatggtgtttaacggcgatgtgctctcgggcgcggatctggcccaactgctggacttccaccgaagcaatcgagccgatgtcacgctgcaactggtgcgggtgggcgacccgcgggcattcggctgcgtacccaccgacgaggaggaccgcgtagtcgcctttctggagaagacggaggatccgccgaccgaccagatcaatgccggctgctatgtcttcgaacgcaacgtcatcgaccggattccgcagggccgggaggtttcggtggaacgcgaggtgttcccggccttgctcgccgacggcgactgcaagatctacggctatgtcgatgccagctattggcgggacatgggcacaccggaagacttcgttcgcggatcggcggatctggtgcgcggcatcgccccgtctccggccttgcgtggtcaccgcggtgagcagttggtgcacgacggtgcggcggtatctcccggtgcgttgctgattggcggcaccgtcgtggggcgtggtgccgaaatcggccccggcaccagattggacggcgcggtcatcttcgatggtgtccgggtggaggccgggtgcgtgatcgagcgttcgatcatcggcttcggtgctcgcatcggaccgcgggcgttgatccgcgacggtgtgatcggtgacggggccgacatcggcgcgcgctgcgagttgttaagtggtgcccgggtatggcccggtgtctttcttcccgacggcgggatccgttactcgtccgacgtttga

SEQ ID NO: 124 - DNA, 645 bp, Mycobacterium tuberculosis
atgaccctcaacctgtccgtcgacgaggtcctgaccactacccgctcggtgcgcaagcgtctcgatttcgacaagccggtgccacgcgacgtgctgatggaatgcctcgagctggcgctgcaggcgcccaccggttccaattcccaaggctggcagtgggtgttcgtcgaggacgccgccaagaaaaaggcgatcgccgacgtctacctggccaacgcccggggctacctcagcgggccggcgcccgagtaccccgacggcgacacccgcggcgagcggatggggcgggtccgcgattcggcgacctatctcgccgaacacatgcaccgggcgccggtgctgctgatcccctgcctgaaaggccgggaagacgagtcggcggtgggtggcgtgtcgttttgggcctcactgttcccggcggtgtggagcttctgcctggcgctgcgctcccgcgggctgggttcgtgctggacgacgctgcacctgctcgacaacggcgagcacaaggtggccgacgtgctcggcattccctacgacgaatacagccaaggcgggctgcttccgatcgcctacacacaaggcatcgacttccggccggccaagcggctgccggccgagagcgtgacgcactggaacggctggtaa

SEQ ID NO: 125 - DNA, 990 bp, Mycobacterium tuberculosis
atggctgaggtgttcgtgggaccggtcgcacagggatacgcttcgggtgaagtcacggtgctgttggcgtcgccgcggtcgttttgcgccggtgtagagcgtgctatcgagacggtcaagcgagtgcttgacgtggccgaaggcccggtgtatgtgcgcaagcaaatcgtgcacaacactgttgtggttgccgagttgcgggaccggggagcagtgttcgtcgaggatctcgacgagattcccgatccgccgccgccgggggcggtcgtggtgttctccgcgcatggggtttccccggcggtgcgcgcgggcgctgatgagcggggactgcaggtcgtcgacgcgacctgcccactggtggcgaaagtccacgctgaagccgcacggtttgccgcgcgcggtgacacggtggtcttcatcgggcacgccggacatgaggagaccgaaggcacgcttggcgtcgctccgcggtcaacattattggtgcagacacccgctgatgtggcagcgttgaacctgcccgagggtacccagctatcgtatctgacccagacaaccctggcacttgatgaaactgccgatgtcattgatgcgctgcgcgcgaggtttccgacgttgggccaacccccctctgaagacatctgctatgccaccacgaacagacagcgtgcgctgcaatcgatggtcggtgaatgtgacgttgtgttggtgattggctcgtgcaattcgtcgaattcgcggcgtctggtcgagttggcgcagcgaagtgggacgccggcctacttgattgacgggcctgatgacattgagcccgaatggctgtcgtcggtctcgacgatcggtgtcaccgcgggagcctccgcgccgccacgactggtggggcaggtgattgatgcacttcgcggatacgcctcgatcaccgtggtggaacgctcgatagcgaccgagacggtgcgattcggccttcccaaacaggttcgcgcgcaatga

SEQ ID NO: 126 - DNA, 303 bp, Mycobacterium tuberculosis
gtggcgaaggtgaacatcaagccactcgaggacaagattctcgtgcaggccaacgaggccgagaccacgaccgcgtccggtctggtcattcctgacaccgccaaggagaagccgcaggagggcaccgtcgttgccgtcggccctggccggtgggacgaggacggcgagaagcggatcccgctggacgttgcggagggtgacaccgtcatctacagcaagtacggcggcaccgagatcaagtacaacggcgaggaatacctgatcctgtcggcacgcgacgtgctggccgtcgtttccaagtag

SEQ ID NO: 127 - DNA, 1227 bp, Mycobacterium tuberculosis
gtgaaacggttctgggagaatgtcggaaagccaaacgacacgacagatgggcggggcacgacttcgttggccatgacaccgatatcccagacacctggcctcctcgccgaggccatggtggatctgggcgctattgaacacaacgtgcgggtgctgcgtgagcacgccggccacgcgcagctgatggcggtggtcaaggccgacggctacggtcacggtgctacgcgcgtcgcccaaaccgccctgggagccggtgcggccgaactcggcgtcgccaccgtcgacgaggcgctagcgctgcgcgctgatggcattaccgcaccggtgctggcctggctgcatccgcccggcatcgacttcgggcccgcgctgctggccgacgtgcaggtcgcggtgtcctcgctgcgccaactcgacgaactgttgcacgcggtgcgccggaccggccggacggcgacggtgaccgtcaaggtggataccgggctgaaccgcaatggcgtgggaccggcacaattcccggccatgctgaccgcgttacgccaagccatggccgaggacgccgtccggctgcgggggctgatgtcgcatatggtttacgccgacaagcctgacgattccatcaacgatgttcaggcccaacggtttaccgcctttctggcgcaggcccgcgaacaaggggtgcggttcgaggtggcgcatctatcgaactcatcagcaactatggcgcgccccgacctgacgttcgacctggtgcggccgggcatcgcggtgtatgggctaagcccggtacccgccctcggtgacatggggctggtgccggcgatgaccgtgaaatgtgctgttgcgctggtgaaatcgattcgtgcgggggagggcgtgtcgtatgggcacacatggatcgcgccacgcgacaccaatctggcgctgctgccgatcggttacgcagacggcgtgttccggtcgctgggcgggcggctggaggtgctgatcaacggcagacgatgccccggtgtggggcggatctgcatggaccagttcatggtcgacctgggccccgggccgcttgatgtggccgaaggcgacgaggcgattttgttcgggccgggcatccggggtgagcccacggctcaggactgggccgatcttgtcggcaccatccactacgaagtggtcaccagcccgcgaggacgtatcaccaggacctatcgcgaggctgaaaaccgttga

SEQ ID NO: 128 - DNA, 1503 bp, Mycobacterium tuberculosis
atggctccctcgggaggccaggaggcgcagatttgcgattcggagaccttcggggactctgacttcgtggtggtagccaatcgactgcccgtcgatctggagcgtcttcccgacggcagcacaacctggaaacgcagccccggaggcttggtcaccgccttggagccggtgctgcggcgtcggcgcggggcctgggtcggctggcccggcgttaacgacgacggggccgaacccgacctccacgtgctggacggccccatcatccaagacgagctggaacttcatccggtacggctgagcaccacggacatagctcagtactacgagggattctccaacgccacactgtggccgctgtaccacgacgtcatcgtcaagccgctctaccaccgcgaatggtgggatcgctacgtcgacgtcaaccagcgctttgccgaggccgcgtcgcgcgccgccgcccacggcgcaaccgtgtgggtacaggactaccagctgcagctggtaccgaagatgctgcgcatgctgcggcccgatctgaccatcggtttctttttgcacatcccgttcccgccggtagagctgtttatgcagatgccgtggcgcaccgagatcatccagggcctactgggcgccgacctggtgggcttccatcttccgggcggtgcccagaatttcctgatcctgtcccggcgtctggtcggcaccgacacttcccgcggaaccgtcggtgtgcggtcgcggttcggtgcggcggtgctcgggtcccgcaccatacgagttggcgcctttcctatctcggttgactccggcgcgctcgaccacgctgcccgcgaccgcaacatcaggcgccgggcccgcgagattcgcaccgaactgggaaatccgcgcaagatcctgctcggtgttgaccggctcgactacaccaagggcatcgacgtacggctgaaggccttttccgagctgctggccgagggccgcgtcaaacgcgacgacaccgtcgtggtccagctggctaccccgagccgcgagcgggtggagagctaccagacgctgcgcaacgacatcgaacgccaggtcggccacattaacggcgagtacggtgaggttggccatccggtagtgcattacctgcatcgaccggctccgcgcgacgagcttatcgctttcttcgtggccagcgacgtcatgctggtcaccccactacgcgacgggatgaacctggtggccaaggagtacgtcgcttgccgcagcgatcttggcggtgccctggtgctcagcgaattcaccggggccgcagccgaactccggcacgcatacctggtcaacccgcacgacctggaaggcgtcaaggacgggatagaggaagcgctcaaccagacggaggaggcgggccggcggcgaatgcggtcgctgcgacgccaagtgctcgcccacgacgtggaccgctgggcacagtcgtttctcgacgctctcgccggggcacacccgaggggccaaggctaa

SEQ ID NO: 129 - DNA, 1518 bp, Mycobacterium tuberculosis
gtgagtgccgctgacacagcagaagaccttcctgagcagttccggattcgccgggacaagcgcgctcgcttgctggcccaggggcgcgatccctatcccgtcgcggtgccgcgcactcacacgttggccgaggttcgcgccgcccaccctgacttgccgatcgataccgcgaccgaagacatcgtcggcgtcgcgggccgagtgatctttgcgcgcaactcgggaaagctatgctttgcgacacttcaggacggcgatggtacccagctgcaagtgatgatcagcctcgacaaggtcggccaggctgctctcgacgcatggaaagccgatgtcgacctgggcgacatcgtctacgtgcatggcgcggtgatcagttcgcgccgcggcgagctgtccgtcctggcggattgctggcggatcgccgccaagtcgctgcggccgcttcccgtcgcgcacaaagagatgagtgaagagtcgcgggttcgtcagcgctatgttgacctcatagttcgaccggaagcgcgcgcggtggctcgactacggatcgccgtcgtccgcgcgatccggacggcgcttcaacgtcgtgggttcctggaagtcgagacgcccgtcttgcagacgttagccggtggtgcggcggcccgtccgttcgccactcattccaatgccctagacatcgatctgtacctgcggatcgcgccggaactgttcctcaagcgctgcatcgtgggtggtttcgacaaggtcttcgaacttaatcgagtgttccgaaacgaaggagccgattccacgcattctccggaattctccatgctggagacctaccagacctacggaacctatgacgattcggcagtcgtcacccgggagcttattcaagaggtggccgatgaggcgatcggaaccagacaactgccgttgcccgacggcagtgtctatgacatcgacggagaatgggcgactatacaaatgtacccgtcgctgtctgtggcgctcggtgaagagatcacaccgcagacgacggtcgatcgcttacgtgggatcgccgatagccttggcctggagaaagacccagcgattcatgacaaccgtggcttcggccacggcaaactcatcgaggaactctgggagcgcacagtgggcaagagcttgagcgcacccacatttgtcaaggattttccggttcagacaacgcctttgacccgtcagcaccgcagtatccccggcgtaaccgagaagtgggacctctatctgcgcggaatcgaacttgccaccggctactcggaattaagcgacccggtagtccagcgggagagattcgccgaccaggcccgtgccgcggccgctggcgatgacgaagcgatggtgcttgacgaggattttctggccgctctggagtacggcatgccaccgtgcaccggaaccggaatgggtatcgatcggttgttgatgtctttgactgggttgtcaattagggagacagttttgttcccgattgttcgaccacactccaactga

SEQ ID NO: 130 - DNA, 819 bp, Mycobacterium tuberculosis
gtgctgctggcgattgacgtccgcaacacccacaccgttgtgggcctgctgtccggaatgaaagagcacgcaaaggtcgtgcagcagtggcggatacgcaccgaatccgaagtcaccgccgacgaactggcactgacgatcgacgggctgatcggcgaggattccgagcggctcaccggtaccgccgccttgtccacggtcccgtccgtgctgcacgaggtgcggataatgctcgaccagtactggccgtcggtgccgcacgtgctgatcgagcccggagtacgcaccgggatccctttgctcgtcgacaacccgaaggaagtgggcgcagaccgcatcgtgaactgtttggccgcctatgaccggttccggaaggccgccatcgtcgttgactttggatcctcgatctgtgttgatgttgtatcggccaagggtgaatttcttggcggcgccatcgcgcccggggtgcaggtgtcttccgatgccgcggcggcccgctcggcggcattgcgccgcgttgaacttgcccgcccacgttcggtggttggcaagaacaccgtcgaatgcatgcaagccggtgcggtgttcggcttcgccgggctggtagacgggttggtaggccgcatccgcgaggacgtgtccggtttctccgtcgaccacgatgtcgcgatcgtggctaccgggcataccgcgcccctgctgctgccggaattgcacaccgtcgaccattacgaccagcacctgaccttgcagggtctgcggctggtgttcgagcgtaacctcgaagtccagcgcggccggctcaagacggcgcgctga

SEQ ID NO: 131 - DNA, 567 bp, Mycobacterium tuberculosis
atgacgcgggtagtgctctcggttggctccaacctgggtgaccgcctggcacgattgcggtcggtcgccgacggtctcggcgatgcgttgattgcggcttccccgatatatgaggccgacccctggggtggggtggagcaggggcagttcctcaatgcggtgctgatcgccgacgatcctacctgcgaaccgcgggagtggctgcggcgggcgcaggagttcgagcgcgctgcgggcagggtgcgtggccagcgctggggtccacgaaatctcgacgtcgacctgatcgcctgctaccagacctcggccaccgaggctctggtcgaagtgaccgcgcgggagaaccacctcacgctgccgcacccactggcgcatctgcgggcctttgtgttgatcccgtggattgccgtcgacccaacggcgcagctgacggttgccgggtgcccgcggcccgtcacgcgactgctggccgagctggagcccgccgaccgcgacagtgtgcggttgtttaggccgtcgttcgatctgaatagcagacaccccgtcagtcgggcaccggaaagctga

SEQ ID NO: 132 - DNA, 402 bp, Mycobacterium tuberculosis
atggctgaccgaatcgaactgcgcggcctgaccgtgcatggtcggcacggggtctacgaccacgagcgagtggccgggcagcggtttgtcatcgatgtcaccgtgtggatagacctggccgaggccgccaacagcgacgacttggccgacacctatgactacgtgcggctggcttcgcgggcggccgagatcgtcgccggacccccgcggaagctgatcgaaacggtcggggccgagatcgctgatcacgtgatggacgaccagcgagtgcatgccgttgaggtggcggtacacaagccgcaggcgcccattccgcagacgttcgacgatgtggcggtggtgatccgacgctcacggcgcggcggccgcggttgggtagtcccggcgggcggcgcggtatga

SEQ ID NO: 133 - DNA, 843 bp, Mycobacterium tuberculosis
gtgagtccggcgcccgtgcaggtgatgggggttctaaacgtcacggacgactctttctcggacggcgggtgttatctcgatctcgacgatgcggtgaagcacggtctggcgatggcagccgcaggtgcgggcatcgtcgacgtcggtggtgagtcgagccggcccggtgccactcgggttgacccggcggtggagacgtctcgtgtcatacccgtcgtcaaagagcttgcagcacaaggcatcaccgtcagcatcgataccatgcgcgcggatgtcgctcgggcggcgttgcagaacggtgcccagatggtcaacgacgtgtcgggtgggcgggccgatccggcgatggggccgctgttggccgaggccgatgtgccgtgggtgttgatgcactggcgggcggtatcggccgataccccgcatgtgcctgtgcgctacggcaacgtggtggccgaggtccgtgccgacctgctggccagcgtcgccgacgcggtggccgcaggcgtcgacccggcaaggctggtgctcgatcccgggcttggattcgccaagacggcgcaacataattgggcgatcttgcatgcccttccggaactggtcgcgaccggaatcccagtgctggtgggtgcttcgcgcaagcgcttcctcggtgcgttgttggccgggcccgacggcgtgatgcggccaaccgatgggcgtgacaccgcgacggcggtgatttccgcgctggccgcactgcacggggcctggggtgtgcgggtgcatgatgtgcgggcctcggtcgatgccatcaaggtggtcgaagcgtggatgggagcggaaaggatagaacgcgatggctga

SEQ ID NO: 134 - DNA, 609 bp, Mycobacterium tuberculosis
atgtcgcagctggattcgcgcagcgcatctgctcgtatccgtgtgttcgaccagcaacgtgccgaggccgcggtgcgcgaattgctgtacgcgatcggcgaggatccggatagggacggcttggtagccaccccgtcccgggttgcccggtcataccgcgaaatgttcgccgggctctacaccgaccccgactcggtgttgaacaccatgttcgacgaagaccacgacgagctggtgttggtcaaggaaatccctatgtactccacctgcgaacaccacctggtggcgttccacggtgtggcccacgtcggctacatcccgggcgacgacggcagggtgaccggcttgtcaaagatcgcgcgactggtcgatctgtacgccaagcgacctcaggtccaggagcggctcaccagtcagatcgccgatgccctgatgaaaaaactcgatccacgcggggtaatcgtggtgatcgaggctgagcatctgtgcatggcgatgcgcggggttcgcaagcccggctcggtcaccactacgtcggcggtgcgcggactgttcaaaaccaatgccgcttctcgagccgaagcgctcgacctcattttgcggaagtga

SEQ ID NO: 135 - DNA, 2283 bp, Mycobacterium tuberculosis
atgaaccggaaaaacgtgactcgcaccataacagcgatcgccgtcgtggtgctgctcggctggtcgttcttttacttcagcgacgacacccgcggctacaagcccgttgatacctcggtggcgataacacagatcaacggcgacaacgtcaagagcgcacagatcgacgatcgcgagcaacagctgcggctgatcctgaagaagggtaacaacgagaccgacgggtccgagaaggtcatcaccaagtaccccaccgggtacgccgtcgacctgttcaacgcgctcagcgccaaaaacgcgaaggtcagcacggtcgtcaaccagggcagcatcctgggcgagctgctggtctacgtgctgccgctgctgttgctggtggggctgttcgtgatgttctcccgcatgcaaggcggcgcccggatgggcttcgggttcggcaagtcacgcgccaagcaactgagcaaggacatgcccaagaccaccttcgccgacgtcgcaggtgtcgacgaggcggtcgaggagctctacgagatcaaggacttcctgcagaaccccagcaggtaccaagcgctgggcgccaagatccccaaaggcgtgctgctctacgggccgccgggaaccggtaagacgttgctggctcgtgcggtggccggcgaagccggagtgccgttcttcaccatctccggctccgacttcgtcgaaatgttcgtcggcgtcggcgcatcccgtgtcagagacctgttcgagcaggccaagcagaacagcccgtgcatcatcttcgtcgacgagatcgacgccgtcggccgacaaagaggcgccgggctgggcggcggtcacgacgagcgtgagcagaccctcaaccagttgctagtcgaaatggacggttttggcgatcgcgccggcgtcatcctgatcgcggccaccaaccggcccgacatcctggacccggcgctgttgcggccgggccgcttcgaccgccagatcccggtatccaaccccgatctggcgggtcggcgggcggtgctgcgcgtgcactccaagggcaagccgatggccgcggacgccgacctcgacggactggccaagcggaccgtcggcatgaccggagccgacctggccaacgtcatcaacgaggcggcgctgctgaccgcccgggagaacggcaccgtcatcaccggtcccgccctcgaggaagcggtggaccgggtgatcggcggcccgcgccgcaaaggccggatcatcagcgagcaggagaagaagatcaccgcctatcacgagggcgggcacaccctggccgcttgggcgatgcccgatatcgagccgatttataaggtgacgatcctggcgcgcgggcgtaccggcgggcacgcggtggcggtgccggaagaagacaagggcctgcggacccgctcggaaatgatcgcgcaactggtgttcgcgatgggtgggcgcgccgccgaagaactggtgtttcgtgagccgaccaccggcgcggtgtccgacatcgagcaggccaccaagatagcgcgctcaatggtcaccgaatttggaatgagctccaagctgggcgcggtcaaatacggctccgaacacggcgacccgttcctcggacgtaccatgggcacccagccggactactcccacgaggtcgcccgcgagatcgacgaagaggtccgcaagcttatcgaggcggcgcataccgaagcgtgggaaatcctgaccgaataccgcgacgtgctggacactttggccggcgagctgctggaaaaggagaccctgcaccgacccgagctggaaagcatcttcgctgacgtcgaaaagcggccgcggctcaccatgttcgacgacttcggtggccggatcccgtcggacaaaccgcccatcaagacacccggcgagctcgcgatcgaacgcggcgaaccttggccccagccggtccccgagccggcgttcaaggcggcgattgcgcaggctacccaagccgctgaggccgcccggtccgacgccggccaaaccgggcacggcgccaacggttcgcccgccggcacccaccggtccggtgaccgccagtacggctccacccagcctgactacggtgccccggcgggctggcatgcgccgggatggcccccaaggtcatctcatcggcccagctatagcggtgaaccggcaccgacgtatccgggtcagccctacccgaccggtcaagccgatccgggttccgatgagtcctcggcggagcaggatgacgaggtcagtcggaccaagccggcccacggctga

SEQ ID NO: 136 - DNA, 1194 bp, Mycobacterium tuberculosis
atgaccccgtcgcagtggctggatatcgccgtcttggcggtcgcatttattgcagccatctccggctggcgtgccggtgcgctgggctcaatgctgtcgtttggcggggtgctgctgggcgcgacagccggcgtgctgctggcgccgcatatcgtcagtcaaatcagcgctccgcgggccaaactgtttgccgcgctgttcctgatcctggcactggtcgtagtcggcgaggtcgctggtgtggtgctgggccgcgccgtccgcggggcgatccgtaaccggccgatccggttgatcgactcggtcattggggtaggggtgcagctggtcgtggtgctcaccgcggcgtggttgttggcgatgccgctgacacagtcgaaagagcagcccgagctggctgccgcggtgaagggttcgcgggtgctcgcccgggtcaacgaggcggcacccacctggctgaagacggtgcccaagcggctgtcggccctgctgaacacctccggcctgcccgcggttttggagccgttcagccgcacgccggtcattccagtggcctcacccgacccagcgctggtcaacaatccggtggtggcggccaccgagccaagtgtcgtcaaaatccgcagcctggcacccagatgccagaaagtgttggagggcaccggcttcgtgatctcacccgatcgggtgatgaccaacgcgcacgtggtggccggatccaacaacgtcacggtgtatgccggcgacaagcccttcgaggccacggtggtgtcctacgacccgtcggtcgacgtagcgatcctggccgttccgcacttgccgccgccgccgctggtcttcgctgcggagccggcgaaaaccggtgccgacgttgtggtgctgggttatcccggcggcggcaatttcactgccacacccgccaggattcgcgaggccatcagactcagtggccccgatatttacggggacccggagccggttacccgcgacgtgtacaccatcagagccgatgtggagcaaggtgattcgggtgggcccctgatcgacctcaacggtcaggtgctcggtgtggtgttcggcgcagccatcgacgacgccgaaactgggtttgtgctgacggccggcgaggtggcggggcagcttgccaaaatcggtgctacccaaccggtcggcaccggggcctgcgtcagctga

SEQ ID NO: 137 - DNA, 2433 bp, Mycobacterium tuberculosis
atgcccgagcgcctcccggccgcgatcaccgttctgaagctggctgggtgctgtctgttggccagtgtcgtcgccactgcgctgacgttcccgttcgcaggcgggctagggctgatgtccaatcgtgcctctgaggtcgttgccaacggctcggcccagctgctcgaggggcaagtgcctgcggtatcgacgatggtcgacgcgaagggcaacacgatcgcgtggctgtactcgcagcgccggttcgaggtgccctcggacaagatcgccaacacgatgaagctggcgatcgtctcgattgaagataagcggttcgccgaccacagcggcgtggactggaagggcaccctgaccggcctggcgggctacgcgtccggcgacctcgacacgcgcggcggctcgacgctcgaacaacagtacgtgaagaactaccaactgctggtgacagcccaaaccgatgccgagaagcgagcggccgtcgaaaccactccggcccgcaagcttcgcgagatccggatggcactcacgctggacaagaccttcacaaaatctgaaatcctgacccgatacttgaacctggtctcgttcggcaataactcgttcggcgtgcaggacgcggcgcaaacgtacttcggcatcaacgcgtccgacctgaattggcagcaagcggcgctgctggccggcatggtgcaatcgaccagcacgctcaacccgtacaccaaccccgacggcgcgctggcccggcggaacgtggtcctcgacaccatgatcgagaaccttcccggggaggcggaggcgttgcgtgccgccaaggccgagccgctgggggtactgccgcagcccaatgagttgccgcgcggctgcatcgcggccggcgaccgcgcattcttctgcgactacgtccaggagtacctgtctcgggccgggatcagcaaggagcaggtcgccacgggcgggtacctgatccgcaccaccctggacccagaggtgcaggcaccggtcaaggccgccatcgacaagtacgccagcccgaacctggccggtatttccagcgtgatgagcgtgatcaaaccgggtaaggatgcgcacaaggtgttggccatggccagtaaccgcaaatacgggctggatctagaagccggcgaaaccatgcggccgcagccattctccctggttggcgacggcgccgggtctatcttcaagatcttcaccacggccgctgctctggacatgggcatgggtattaacgcccaactcgacgtgccgccccgattccaggccaaaggtctgggaagtggcggggcaaaggggtgccccaaagagacctggtgtgtggtgaacgccggcaactaccgcggctcgatgaatgtcaccgacgcgctggcaacctcgccaaacaccgcgttcgccaagctgatctcgcaggtcggggtggggcgtgcggtcgatatggccatcaaactcgggctgaggtcttatgcgaatcccggcaccgcacgcgactacaaccccgacagcaatgagagcttggctgacttcgtcaaacgacagaacctgggttcgttcaccctcggccccatcgagttaaacgcgctggagctgtccaacgtggcggccacgttggcatccggcggcgtgtggtgcccccccaacccaatcgaccagctcatcgaccgcaacggcaacgaagtcgcggtcaccaccgagacgtgcgaccaggtggtgcccgcagggctggcgaacaccctcgccaacgcgatgagcaaggacgccgtgggcagcggcacggcggccggttcggccggcgcggcgggctgggatctgccgatgtccggcaaaaccggcaccaccgaggcgcaccggtcggccggcttcgtgggcttcaccaaccgctacgcggcggcgaactacatctacgacgactccagctcgccgacagatctgtgttccggcccgctgcgccattgcggcagcggcgacttgtacggcggcaacgagccatcccgcacctggttcgccgcgatgaagccgatcgccaacaacttcggcgaagtgcagctaccaccgaccgatccacgctatgtcgacggcgcaccaggctcacgggtaccaagcgtggccggtctggatgtcgacgccgcacgccagcgcctcaaggacgcgggcttccaggtcgccgaccaaaccaactcggtcaacagctccgccaagtatggtgaggtggtcggaacgtcgcccagcggtcaaacaattccgggttcgatcgtcacgatccagatcagcaacggcatcccgccggctccgcctccgccaccgctgcctgaggatggtgggccgccaccgccggtcggatcgcaggtggtggagattccggggctgccgccgatcaccattccgctgctggcgccaccacccccagcgcctcccccgtag

SEQ ID NO: 138 - DNA, 1737 bp, Mycobacterium tuberculosis
gtggctctctaccgcaagtaccgaccggcaagcttcgcggaggtggtggggcaggagcacgtcaccgcgccgctgtcggtggcgctggatgccggccggatcaaccacgcgtacctgttctctgggccgcgtggctgcggaaagacgtcgtcagcgcgtatcctggcgcggtcgttgaactgtgcgcagggccctaccgccaacccgtgcggggtctgcgaatcctgcgtttcgttggcgcccaacgcccccggcagcatcgacgtggtagagctggatgccgccagccacggcggcgtggacgacacccgcgagctgcgggaccgcgcgttctatgcgccggtccagtcacggtaccgggtatttatcgtcgacgaggcgcacatggtgaccaccgcgggattcaacgcgctgctcaagatcgtggaggaaccgcccgaacacctgatcttcatattcgccaccaccgaaccggagaaggtactgccgacgattcggtcgcgcactcatcactacccgttccggctgctgccgccgcgcactatgcgggcgttgctcgcgcggatctgcgagcaggagggcgtcgtcgtcgacgatgcggtgtacccgttggtgatccgggccggcggaggttccccacgggatacgctctcggtgctggaccaattgctggctggggccgcggacacccacgtgacctacacccgggcgctggggctgctgggtgtcaccgacgtcgccctgatcgacgacgcggtcgacgcactggccgcttgcgatgcggccgcattgttcggggcgatcgaatcggtgatcgatggcggacatgaccctcggcgtttcgctaccgatctgctggagcgattccgcgacctgattgtgctgcaatcggttcccgacgcggcatctcgcggggtggtggatgcgcccgaagacgcgctggatcggatgcgcgagcaagccgcccggatcgggcgggcgaccctgacccgatatgccgaggtggtgcaggccgggctaggcgagatgcgcggtgcgaccgcgccgcgtctgctgctggaagtggtttgcgcgcgactgctgctgccctcggcgagcgacgccgaatcggcactgttgcagcgggtcgaacggatcgagacccggttggacatgtcgatcccggcgccgcaagccgtaccacgcccgtcggctgcggctgccgagccgaaacaccagcccgcgcgtgaaccgagaccggtgctggcccccacaccggcctcgagcgaacccaccgtggccgcggttcggtccatgtggccgacggtgcgcgacaaggtgcgcctgcgcagccgtaccaccgaggtgatgctggcgggtgccaccgtccgtgcgctagaggacaacacgctggtgctgacccacgaatcggcgccgctggcgcggcggctgtccgaacagcgcaacgccgatgtcctcgccgaggcgcttaaagacgcgctgggagtcaactggcgggtgcggtgtgagaccggtgaaccggctgcggcggcatcacccgtcggcgggggagcgaacgtggcgaccgccaaggccgtaaaccctgcccccacagcgaattccactcagcgcgacgaagaggagcacatgctcgccgaagccggccgtggcgacccgtcgccgcgtcgcgacccggaagaggttgcactcgagctgctgcagaacgagctgggcgcgcgccggatagacaacgcctag

SEQ ID NO: 139 - DNA, 843 bp, Mycobacterium tuberculosis
atgacattcatggatgctcaagctagcttccagacacagtcgcggacactggcccgcgtccgaggcgatctggtcgacgggttccgccgccacgagctgtggctgcacctgggctggcaggacatcaagcagcggtaccgccgctcggtgctggggccgttctggatcaccatcgccaccggaacgaccgccgtcgcgatgggcggcctgtattccaagctgtttcggctcgagctgtctgagcacctgccctacgtcacgctcgggctgatcgtctggaacctgatcaacgccgccatcctggacggcgcagaggttttcgtcgccaacgaaggtctgatcaaacagctgccggcaccgttgagcgtgcacgtctatcggttggtgtggcggcagatgatcttcttcgcccacaacatcgtcatctacttcgtcatcgcgatcatctttcctaagccgtggtcgtgggcggatctgtcgtttcttccggcgctggcgctcattttcctcaattgcgtttgggtgtcactgtgtttcggcatcctggcgacccgctaccgcgacatcggcccgctgctgttttccgttgtgcagttgttgttcttcatgacgccgatcatctggaacgacgagaccctgcgtcggcagggcgcgggccgctggtcgagcatcgtcgagctcaacccgctgctgcactatctggacatcgtgcgggcgccactgttgggcgctcaccaggagctgcggcactggctggtggtgctggtgttgaccgtcgtcggctggatgctggcggcgttcgcgatgcggcagtatcgcgcgcgggtgccctactgggtgtag

SEQ ID NO: 140 - DNA, 366 bp, Mycobacterium tuberculosis
atgcggttcgttgtcaccggcggcctcgctgggatagttgactttggcctctacgtcgtgctgtacaaggtggcgggcctacaggtcgacctgtccaaggccatcagcttcatcgtcggcaccatcaccgcgtacctgatcaaccgccggtggacattccaggccgagcccagcacggcccgattcgtcgcggtcatgctcctctacggaatcaccttcgccgtgcaggtcggactcaaccacctctgcctcgcactcttgcactaccgggcgtgggccatccccgtcgcgtttgtgatcgcgcagggcaccgccacggtaatcaacttcatcgtgcagcgagccgtgatcttccggatccgctga

SEQ ID NO: 141 - DNA, 1386 bp, Mycobacterium tuberculosis
atgttgagcgtgggagctaccactaccgccacccggctgaccgggtggggccgcacagcgccgtcggtggcgaatgtgcttcgcaccccagatgccgagatgatcgtcaaggcggtggctcgggtcgccgagtcggggggcggccggggtgctatcgcgcgcgggctgggccgctcctatggggacaacgcccaaaacggcggtgggttggtgatcgacatgacgccgctgaacactatccactccattgacgccgacaccaagctggtcgacatcgacgccggggtcaacctcgaccaactgatgaaagccgccctgccgttcgggctgtgggtcccggtgctgccgggaacccggcaggtcaccgtcggcggggcgatcgcctgcgatatccacggcaagaaccatcacagcgctggcagcttcggtaaccacgtgcgcagcatggacctgctgaccgccgacggcgagatccgtcatctcactccgaccggcgaggacgccgaactgttctgggccaccgtcgggggcaacggtctcaccggcatcatcatgcgggccaccatcgagatgacgcccacttcgacggcgtacttcatcgccgacggcgacgtcaccgccagcctcgacgagaccatcgccctgcacagcgacggcagcgaagcgcgctacacctattccagtgcctggttcgacgcgatcagcgctcccccgaagctgggccgcgcggcggtatcgcgtggccgcctggccaccgtcgagcaattgcctgcgaaactgcggagcgaacctttgaaattcgatgcgccacagctacttacgttgcccgacgtgtttcccaacgggctggccaacaaatataccttcggcccgatcggcgaactgtggtaccgcaaatccggcacctatcgcggcaaggtccagaacctcacgcagttctaccatccgctggacatgttcggcgaatggaaccgcgcctacggcccagcgggcttcctgcaatatcagttcgtgatccccacagaggcggttgatgagttcaagaagatcatcggcgttattcaagcctcgggtcactactcgtttctcaacgtgttcaagctgttcggcccccgcaaccaggcgccgctcagcttccccatcccgggctggaacatctgcgtcgacttccccatcaaggacgggctggggaagttcgtcagcgaactcgaccgccgggtactggaattcggcggccggctctacaccgccaaagactcccgtaccaccgccgaaacctttcatgccatgtatccgcgcgtcgacgaatggatctccgtgcgccgcaaggtcgatccgctgcgcgtattcgcctccgacatggcccgacgcttggagctgctgtag

SEQ ID NO: 142 - DNA, 765 bp, Mycobacterium tuberculosis
atggttcttgatgccgtaggaaacccccagacggtgctgctgctcggtggcacctccgagatcgggctcgccatctgcgagcgctacctgcacaattcggcggcccgcatcgtgctggcctgcctgcccgacgacccacggcgggaggacgcggccgctgcgatgaagcaggccggcgcgcggtcggtggagctgatcgactttgacgccctggataccgacagccacccgaagatgatcgaggcggccttctccggcggtgatgtggacgtggctatcgtcgcgttcggcttgctcggcgacgccgaagagctgtggcagaaccagcgcaaggcggtgcagatcgccgaaatcaactacaccgcagcggtttcggtgggcgtgctgctggctgagaagatgcgcgctcagggcttcggtcagatcatcgcgatgagctcggccgccggtgagcgggtgcgacgggcgaacttcgtctacggctccaccaaggccggtctggacgggttttacctggggttgtcagaagcgctgcgcgagtacggtgttcgtgtgctggtgatccggcccggccaggtgcgtacccggatgagcgcgcacctcaaggaagctccattgaccgtcgacaaggagtacgtcgccaacctcgcggtgaccgcgtccgcaaaaggtaaggaattggtttgggcgccagcagcgttccgctacgtcatgatggtgttgcgtcacatcccgcggagcatcttccgcaagctgcccatctga

SEQ ID NO: 143 - DNA, 3285 bp, Mycobacterium tuberculosis
gtgccccacgacggtaatgagcgatctcaccggatcgcacgcctagcagccgtcgtctcgggaatcgcgggtctgctgctgtgcggcatcgttccgctgcttccggtgaaccaaaccaccgcgaccatcttctggccgcagggcagcaccgccgacggcaacatcacccagatcaccgcccctctggtatccggggcgccacgcgcgctggacatctcgatcccctgctcggccatcgccacgctgcccgccaacggcggcctggtgctgtccacactgccggccggtggcgtggataccggtaaggccgggctgttcgtccgcgccaaccaggacacggtcgtcgtggcgttccgcgactcggtggccgcggtggcggcccgctccacgatcgcagcgggaggctgtagcgcgctgcatatctgggccgataccggcggcgcgggcgctgattttatgggtatacccggcggcgccgggaccctgccgccggagaagaagccacaggttggcggcatcttcaccgacctgaaggtcggagcgcagcccgggctgtcggcccgcgtcgacatcgacactcggtttatcacgacgcccggcgcgctcaagaaggccgtgatgctcctcggcgtgctggcggtcctggtagccatggtggggctggccgcgctggaccggctcagcaggggccgcaccctgcgcgactggctgacccgatatcgcccgcgggtgcgggtcggattcgccagccggctcgctgacgcagcggtgatcgcgaccttgttgctctggcatgtcatcggcgccacctcgtccgatgacggctaccttctgaccgtcgcccgggtcgccccgaaggccggctatgtagccaactactaccggtatttcggcacgacggaggcgccgttcgactggtatacatcggtgcttgcccagctggcggcggtgagcaccgccggcgtctggatgcgcctgcccgccaccctggccggaatcgcctgctggctgatcgtcagccgtttcgtgctgcggcggctgggaccgggcccgggcgggctggcgtccaaccgggtcgctgtgttcaccgctggtgcggtgttcctgtccgcctggctgccgttcaacaacggcctgcgtcccgagccgctgatcgcgctgggtgtgctggtcacgtgggtgttggtggaacggtcgatcgcgctcggacggctggccccggccgcggtagccatcatcgtggcgacgcttaccgcgacgctggcaccgcaggggttgatcgcgctggccccgctgctgactggtgcgcgcgccatcgcccagaggatccggcgccgccgggcgaccgatggactgctggcgccgctggcggtgctggccgcggcgttgtcgctgatcaccgtggtggtgtttcgggaccagacgctggccacggtggccgaatcggcacgcatcaagtacaaggtcggcccgaccatcgcctggtaccaggacttcctgcgctactacttccttaccgtggagagcaacgttgaggggtcgatgtcccgccggttcgcggtgctggtgttgctgttctgcctgttcggggtgctgttcgtgctgctgcggcgcggccgggtggcggggctggccagcggcccggcctggcgactgatcggcactacggcggtcggcctgctgctgctcacgttcacgccaaccaagtgggccgtgcagttcggcgcattcgccgggctggccggggtgttgggtgcggtcaccgcgttcacctttgcccgcatcggtctacatagtcgacgcaacctcacgctgtacgtgaccgcgttgctgttcgtgctggcgtgggcaacctcgggcatcaacgggtggttctacgtcggcaactacggggtgccgtggtatgacatccagcccgtcatcgccagccacccggtgacgtcgatgtttctgacgctgtcgatcctcaccggattgctggcagcctggtatcacttccggatggactacgccgggcacaccgaagtcaaagacaaccggcgcaaccgcatcttggcctctacgccactgctggtggtcgcggtgatcatggtcgcaggcgaagtcggctcgatggccaaggccgcggtgttccgttacccgctttacaccaccgccaaggccaacctgaccgcgctcagcaccgggctgtccagctgtgcgatggccgacgacgtgctggccgagcccgaccccaatgccggcatgctgcaaccggttccgggccaggcgttcggaccggacggaccgctgggcggtatcagtcccgtcggcttcaaacccgagggcgtgggcgaggacctcaagtccgacccggtggtctccaaacccgggctggtcaactccgatgcgtcgcccaacaaacccaacgccgccatcaccgactccgcgggcaccgccggagggaagggcccggtcgggatcaacgggtcgcacgcggcgctgccgttcggattggacccggcacgtaccccggtgatgggcagctacggggagaacaacctggccgccacggccacctcggcctggtaccagttaccgccccgcagcccggaccggccgctggtggtggtttccgcggccggcgccatctggtcctacaaggaggacggcgatttcatctacggccagtccctgaaactgcagtggggcgtcaccggcccggacggccgcatccagccactggggcaggtatttccgatcgacatcggaccgcaacccgcgtggcgcaatctgcggtttccgctggcctgggcgccgccggaggccgacgtggcgcgcattgtcgcctatgacccgaacctgagccctgagcaatggttcgccttcaccccgccccgggttccggtgctggaatctctgcagcggttgatcgggtcagcgacaccggtgttgatggacatcgcgaccgcagccaacttcccctgccagcgaccgttttccgagcatctcggcattgccgagcttccgcagtaccggatcctgccggaccacaagcagacggcggcgtcgtcgaacctatggcagtccagctcgaccggcggtccgttcctgttcacccaggcgctgctgcgcacctcgacgatcgccacgtacctgcgtggggactggtatcgcgactggggatcggtggagcagtaccaccggctggtgccggccgatcaggctccagacgccgttgtcgaggagggcgtgatcactgtgcccggctggggtcggccaggaccgatcagggcgctgccatga

SEQ ID NO: 144 - DNA, 3297 bp, Mycobacterium tuberculosis
atgacacagtgcgcgagcagacgcaaaagcaccccaaatcgggcgattttgggggcttttgcgtctgctcgcgggacgcgctgggtggccaccatcgccgggctgattggctttgtgttgtcggtggcgacgccgctgctgcccgtcgtgcagaccaccgcgatgctcgactggccacagcgggggcaactgggcagcgtgaccgccccgctgatctcgctgacgccggtcgactttaccgccaccgtgccgtgcgacgtggtgcgcgccatgccacccgcgggcggggtggtgctgggcaccgcacccaagcaaggcaaggacgccaatttgcaggcgttgttcgtcgtcgtcagcgcccagcgcgtggacgtcaccgaccgcaacgtggtgatcttgtccgtgccgcgcgagcaggtgacgtccccgcagtgtcaacgcatcgaggtcacctctacccacgccggcaccttcgccaacttcgtcgggctcaaggacccgtcgggcgcgccgctgcgcagcggcttccccgaccccaacctgcgcccgcagattgtcggggtgttcaccgacctgaccgggcccgcgccgcccgggctggcggtctcggcgaccatcgacacccggttctccacccggccgaccacgctgaaactgctggcgatcatcggggcgatcgtggccaccgtcgtcgcactgatcgcgttgtggcgcctggaccagttggacgggcggggctcaattgcccagctcctcctcaggccgttccggcctgcatcgtcgccgggcggcatgcgccggctgattccggcaagctggcgcaccttcaccctgaccgacgccgtggtgatattcggcttcctgctctggcatgtcatcggcgcgaattcgtcggacgacggctacatcctgggcatggcccgagtcgccgaccacgccggctacatgtccaactatttccgctggttcggcagcccggaggatcccttcggctggtattacaacctgctggcgctgatgacccatgtcagcgacgccagtctgtggatgcgcctgccagacctggccgccgggctagtgtgctggctgctgctgtcgcgtgaggtgctgccccgcctcgggccggcggtggaggccagcaaacccgcctactgggcggcggccatggtcttgctgaccgcgtggatgccgttcaacaacggcctgcggccggagggcatcatcgcgctcggctcgctggtcacctatgtgctgatcgagcggtccatgcggtacagccggctcacaccggcggcgctggccgtcgttaccgccgcattcacactgggtgtgcagcccaccggcctgatcgcggtggccgcgctggtggccggcggccgcccgatgctgcggatcttggtgcgccgtcatcgcctggtcggcacgttgccgttggtgtcgccgatgctggccgccggcaccgtcatcctgaccgtggtgttcgccgaccagaccctgtcaacggtgttggaagccaccagggttcgcgccaaaatcgggccgagccaggcgtggtataccgagaacctgcgttactactacctcatcctgcccaccgtcgacggttcgctgtcgcggcgcttcggctttttgatcaccgcgctatgcctgttcaccgcggtgttcatcatgttgcggcgcaagcgaattcccagcgtggcccgcggaccggcgtggcggctgatgggcgtcatcttcggcaccatgttcttcctgatgttcacgcccaccaagtgggtgcaccacttcgggctgttcgccgccgtaggggcggcgatggccgcgctgacgacggtgttggtatccccatcggtgctgcgctggtcgcgcaaccggatggcgttcctggcggcgttattcttcctgctggcgttgtgttgggccaccaccaacggctggtggtatgtctccagctacggtgtgccgttcaacagcgcgatgccgaagatcgacgggatcacagtcagcacaatctttttcgccctgtttgcgatcgccgccggctatgcggcctggctgcacttcgcgccccgcggcgccggcgaagggcggctgatccgcgcgctgacgacagccccggtaccgatcgtggccggtttcatggcggcggtgttcgtcgcgtccatggtggccgggatcgtgcgacagtacccgacctactccaacggctggtccaacgtgcgggcgtttgtcggcggctgcggactggccgacgacgtactcgtcgagcctgataccaatgcgggtttcatgaagccgctggacggcgattcgggttcttggggccccttgggcccgctgggtggagtcaacccggtcggcttcacgcccaacggcgtaccggaacacacggtggccgaggcgatcgtgatgaaacccaaccagcccggcaccgactacgactgggatgcgccgaccaagctgacgagtcctggcatcaatggttctacggtgccgctgccctatgggctcgatcccgcccgggtaccgttggcaggcacctacaccaccggcgcacagcaacagagcacactcgtctcggcgtggtatctcctgcctaagccggacgacgggcatccgctggtcgtggtgaccgccgcgggcaagatcgccggcaacagcgtgctgcacgggtacacccccgggcagactgtggtgctcgaatacgccatgccgggacccggagcgctggtacccgccgggcggatggtgcccgacgacctatacggagagcagcccaaggcgtggcgcaacctgcgcttcgcccgagcaaagatgcccgccgatgccgtcgcggtccgggtggtggccgaggatctgtcgctgacaccggaggactggatcgcggtgaccccgccgcgggtaccggacctgcgctcactgcaggaatatgtgggctcgacgcagccggtgctgctggactgggcggtcggtttggccttcccgtgccagcagccgatgctgcacgccaatggcatcgccgaaatcccgaagttccgcatcacaccggactactcggctaagaagctggacaccgacacgtgggaagacggcactaacggcggcctgctcgggatcaccgacctgttgctgcgggcccacgtcatggccacctacctgtcccgcgactgggcccgcgattggggttccctgcgcaagttcgacaccctggtcgatgcccctcccgcccagctcgagttgggcaccgcgacccgcagcggcctgtggtcaccgggcaagatccgaattggtccatag

SEQ ID NO: 145 - DNA, 1260 bp, Mycobacterium tuberculosis
gtgatcgacctgaagctgcttcgtgaaaaccccgacgcggtacgccgctcacaactcagccgcggcgaggacccggcgctggtagatgccctgctgacggccgacgccgcccgccgggccgtgatctcgaccgccgattcgttacgggccgagcagaaagccgccagcaaaagcgtgggtggcgcgtctcccgaagagcgcccgccgctgctgcggcgcgcgaaggaactcgccgagcaggtcaaagccgctgaggccgacgaggtcgaagcggaggcggcgttcaccgcggcgcacctggcgatctcgaatgtcatcgtggacggggtacccgccggcggggaggacgactacgcggtgctcgacgtcgtcggcgagcccagctacctcgagaaccccaaggaccacctggagctcggcgagtcgctgggcctgatcgacatgcagcgcggcgccaaggtgtcgggttcacggttctacttcctgaccggtcggggtgccctactgcagcttggattgctgcagctggcgctgaagctagccgtcgacaacggctttgtccctacgatcccgccggtgctggtgcgcccggaagtgatggtaggcacgggatttctaggcgcccacgccgaggaggtgtaccgggtagagggcgacggcctctaccttgtgggcacctccgaggtaccgctggcggggtatcactccggcgagattctggacctttcccgcgggccgctgcggtatgcgggctggtcgtcgtgtttccgacgtgaggccggcagccatggcaaggacacgcgcggcatcatccgggtgcaccagttcgacaaagtcgagggcttcgtctactgcacaccggccgacgcggagcacgaacatgagcggctgctgggctggcagcgccagatgctggcacgcatcgaggtgccgtatcgggtcatcgacgtggccgcgggtgatctcggctcgtcggccgcccgcaagttcgactgcgaggcgtggattccgacgcagggggcctatcgcgagctgacgtcgacgtcgaactgcaccacctttcaggcgcgccggttggcgacccgctaccgggatgccagcggcaagccgcagatcgcggccaccctcaacggaacgctggccaccacccggtggctggttgcgatcctggagaaccaccagcggcccgacggcagcgttagagtcccggacgcactggttccgttcgtgggtgtcgaagtgctggagccggtcgcttag

SEQ ID NO: 146 - DNA, 1443 bp, Mycobacterium tuberculosis
gtgccggaagccgtccaggaagccgatctgctaaccgccgctgcggttgccttgaacaggcatgctgccttattgcgggaactcgggtcggtgttcgccgccgcgggacacgagttgtatctggtcggcggttcggtgcgagatgcactgttgggccggttgagccccgacctggacttcaccaccgacgcccgtcccgagcgggtgcaggagatcgtgcggccgtgggccgatgcggtgtgggataccggaatcgaattcggcaccgtcggcgtgggtaagagcgaccaccgcatggagatcaccacattccgtgccgacagctacgaccgggtttcgcgtcatccagaggtacgtttcggcgattgcctcgagggcgatctggtccgccgcgacttcaccacgaacgcaatggctgtgcgcgtcaccgccactgggccgggcgaattcctggatccgcttggtggcttggcggcgctgcgggccaaggtgttagacaccccggcggcgccgtcggggtcctttggcgacgatccgttgcggatgctgcgcgccgcgcggttcgtctcgcaacttggattcgcggtggcgccgcgggtgcgcgcggcgatcgaagagatggcgccgcagttggcccgaatcagcgccgaacgggtggccgccgagctggacaagctgctggtcggtgaggatccggccgcgggtatcgacctgatggtgcagagcggtatgggtgctgtggtcttgcctgaaatcggtgggatgcggatggcgatcgacgaacatcaccagcacaaggacgtctatcagcattccttgaccgtgctgcggcaggcgatcgcgctggaggacgacggcccggatctggtgttgcgctgggcggcgctgctgcacgacatcggcaagcccgccacccgccgtcacgaacccgacggtggggtgagcttccatcaccacgaagtggtcggcgccaagatggtgcgcaagcggatgcgggcgctgaagtattccaagcagatgatcgacgacatctcgcagctggtctacctgcatctgcggtttcacggctacggcgatgggaaatggaccgactctgcggtgcgccgctatgtcaccgacgccggggccctactgccacggctgcacaagctggtgcgcgccgactgcacgacccgcaacaagcgccgggccgcgcggttgcaggccagttacgaccggctggaagagcggatcgcggagctggccgcccaggaggatctggatcgggtgcgccccgacctggacggcaaccagatcatggcggtgctcgacattccggcgggcccgcaagtcggcgaggcgtggcgctacttgaaggagctgcggctagagcgcggcccgttgtccaccgaggaggcgacaaccgagctgctgtcctggtggaaatcacgggggaaccgctag

SEQ ID NO: 147 - protein, 402 aa, Mycobacterium tuberculosis
MDAATTRVGLTDLTFRLLRESFADAVSWVAKNLPARPAVPVLSGVLLTGSDNGLTISGFDYEVSAEAQVGAEIVSPGSVLVSGRLLSDITRALPNKPVDVHVEGNRVALTCGNARFSLPTMPVEDYPTLPTLPEETGLLPAELFAEAISQVAIAAGRDDTLPMLTGIRVEILGETVVLAATDRFRLAVRELKWSASSPDIEAAVLVPAKTLAEAAKAGIGGSDVRLSLGTGPGVGKDGLLGISGNGKRSTTRLLDAEFPKFRQLLPTEHTAVATMDVAELIEAIKLVALVADRGAQVRMEFADGSVRLSAGADDVGRAEEDLVVDYAGEPLTIAFNPTYLTDGLSSLRSERVSFGFTTAGKPALLRPVSGDDRPVAGLNGNGPFPAVSTDYVYLLMPVRLPG

SEQ ID NO: 148 - protein, 385 aa, Mycobacterium tuberculosis
VYVRHLGLRDFRSWACVDLELHPGRTVFVGPNGYGKTNLIEALWYSTTLGSHRVSADLPLIRVGTDRAVISTIVVNDGRECAVDLEIATGRVNKARLNRSSVRSTRDVVGVLRAVLFAPEDLGLVRGDPADRRRYLDDLAIVRRPAIAAVRAEYERVLRQRTALLKSVPGARYRGDRGVFDTLEVWDSRLAEHGAELVAARIDLVNQLAPEVKKAYQLLAPESRSASIGYRASMDVTGPSEQSDIDRQLLAARLLAALAARRDAELERGVCLVGPHRDDLILRLGDQPAKGFASHGEAWSLAVALRLAAYQLLRVDGGEPVLLLDDVFAELDVMRRRALATAAESAEQVLVTAAVLEDIPAGWDARRVHIDVRADDTGSMSVVLP

SEQ ID NO: 149 - protein, 714 aa, Mycobacterium tuberculosis
MGKNEARRSALAPDHGTVVCDPLRRLNRMHATPEESIRIVAAQKKKAQDEYGAASITILEGLEAVRKRPGMYIGSTGERGLHHLIWEVVDNAVDEAMAGYATTVNVVLLEDGGVEVADDGRGIPVATHASGIPTVDVVMTQLHAGGKFDSDAYAISGGLHGVGVSVVNALSTRLEVEIKRDGYEWSQVYEKSEPLGLKQGAPTKKTGSTVRFWADPAVFETTEYDFETVARRLQEMAFLNKGLTINLTDERVTQDEVVDEVVSDVAEAPKSASERAAESTAPHKVKSRTFHYPGGLVDFVKHINRTKNAIHSSIVDFSGKGTGHEVEIAMQWNAGYSESVHTFANTINTHEGGTHEEGFRSALTSVVNKYAKDRKLLKDKDPNLTGDDIREGLAAVISVKVSEPQFEGQTKTKLGNTEVKSFVQKVCNEQLTHWFEANPTDAKVVVNKAVSSAQARIAARKARELVRRKSATDIGGLPGKLADCRSTDPRKSELYVVEGDSAGGSAKSGRDSMFQAILPLRGKIINVEKARIDRVLKNTEVQAIITALGTGIHDEFDIGKLRYHKIVLMADADVDGQHISTLLLTLLFRFMRPLIENGHVFLAQPPLYKLKWQRSDPEFAYSDRERDGLLEAGLKAGKKINKEDGIQRYKGLGEMDAKELWETTMDPSVRVLRQVTLDDAAAADELFSILMGEDVDARRSFITRNAKDVRFLDV

SEQ ID NO: 150 - protein, 838 aa, Mycobacterium tuberculosis
MTDTTLPPDDSLDRIEPVDIEQEMQRSYIDYAMSVIVGRALPEVRDGLKPVHRRVLYAMFDSGFRPDRSHAKSARSVAETMGNYHPHGDASIYDSLVRMAQPWSLRYPLVDGQGNFGSPGNDPPAAMRYTEARLTPLAMEMLREIDEETVDFIPNYDGRVQEPTVLPSRFPNLLANGSGGIAVGMATNIPPHNLRELADAVFWALENHDADEEETLAAVMGRVKGPDFPTAGLIVGSQGTADAYKTGRGSIRMRGVVEVEEDSRGRTSLVITELPYQVNHDNFITSIAEQVRDGKLAGISNIEDQSSDRVGLRIVIEIKRDAVAKVVINNLYKHTQLQTSFGANMLAIVDGVPRTLRLDQLIRYYVDHQLDVIVRRTTYRLRKANERAHILRGLVKALDALDEVIALIRASETVDIARAGLIELLDIDEIQAQAILDMQLRRLAALERQRIIDDLAKIEAEIADLEDILAKPERQRGIVRDELAEIVDRHGDDRRTRIIAADGDVSDEDLIAREDVVVTITETGYAKRTKTDLYRSQKRGGKGVQGAGLKQDDIVAHFFVCSTHDLILFFTTQGRVYRAKAYDLPEASRTARGQHVANLLAFQPEERIAQVIQIRGYTDAPYLVLATRNGLVKKSKLTDFDSNRSGGIVAVNLRDNDELVGAVLCSAGDDLLLVSANGQSIRFSATDEALRPMGRATSGVQGMRFNIDDRLLSLNVVREGTYLLVATSGGYAKRTAIEEYPVQGRGGKGVLTVMYDRRRGRLVGALIVDDDSELYAVTSGGGVIRTAARQVRKAGRQTKGVRLMNLGEGDTLLAIARNAEESGDDNAVDANGADQTGN

SEQ ID NO: 151 - protein, 626 aa, Mycobacterium tuberculosis
MTTPSHLSDRYELGEILGFGGMSEVHLARDLRLHRDVAVKVLRADLARDPSFYLRFRREAQNAAALNHPAIVAVYDTGEAETPAGPLPYIVMEYVDGVTLRDIVHTEGPMTPKRAIEVIADACQALNFSHQNGIIHRDVKPANIMISATNAVKVMDFGIARAIADSGNSVTQTAAVIGTAQYLSPEQARGDSVDARSDVYSLGCVLYEVLTGEPPFTGDSPVSVAYQHVREDPIPPSARHEGLSADLDAVVLKALAKNPENRYQTAAEMRADLVRVHNGEPPEAPKVLTDAERTSLLSSAAGNLSGPRTDPLPRQDLDDTDRDRSIGSVGRWVAVVAVLAVLTVVVTIAINTFGGITRDVQVPDVRGQSSADAIATLQNRGFKIRTLQKPDSTIPPDHVIGTDPAANTSVSAGDEITVNVSTGPEQREIPDVSTLTYAEAVKKLTAAGFGRFKQANSPSTPELVGKVIGTNPPANQTSAITNVVIIIVGSGPATKDIPDVAGQTVDVAQKNLNVYGFTKFSQASVDSPRPAGEVTGTNPPAGTTVPVDSVIELQVSKGNQFVMPDLSGMFWVDAEPRLRALGWTGMLDKGADVDAGGSQHNRVVYQNPPAGTGVNRDGIITLRFGQ

SEQ ID NO: 152 - protein, 491 aa, Mycobacterium tuberculosis
MNASLRRISVTVMALIVLLLLNATMTQVFTADGLRADPRNQRVLLDEYSRQRGQITAGGQLLAYSVATDGRFRFLRVYPNPEVYAPVTGFYSLRYSSTALERAEDPILNGSDRRLFGRRLADFFTGRDPRGGNVDTTINPRIQQAGWDAMQQGCYGPCKGAVVALEPSTGKILALVSSPSYDPNLLASHNPEVQAQAWQRLGDNPASPLTNRAISETYPPGSTFKVITTAAALAAGATETEQLTAAPTIPLPGSTAQLENYGGAPCGDEPTVSLREAFVKSCNTAFVQLGIRTGADALRSMARAFGLDSPPRPTPLQVAESTVGPIPDSAALGMTSIGQKDVALTPLANAEIAATIANGGITMRPYLVGSLKGPDLANISTTVGYQQRRAVSPQVAAKLTELMVGAEKVAQQKGAIPGVQIASKTGTAEHGTDPRHTPPHAWYIAFAPAQAPKVAVAVLVENGADRLSATGGALAAPIGRAVIEAALQGEP

SEQ ID NO: 153 - protein, 469 aa, Mycobacterium tuberculosis
MTTRLQAPVAVTPPLPTRRNAELLLLCFAAVITFAALLVVQANQDQGVPWDLTSYGLAFLTLFGSAHLAIRRFAPYTDPLLLPVVALLNGLGLVMIHRLDLVDNEIGEHRHPSANQQMLWTLVGVAAFALVVTFLKDHRQLARYGYICGLAGLVFLAVPALLPAALSEQNGAKIWIRLPGFSIQPAEFSKILLLIFFSAVLVAKRGLFTSAGKHLLGMTLPRPRDLAPLLAAWVISVGVMVFEKDLGASLLLYTSFLVVVYLATQRFSWVVIGLTLFAAGTLVAYFIFEHVRLRVQTWLDPFADPDGTGYQIVQSLFSFATGGIFGTGLGNGQPDTVPAASTDFIIAAFGEELGLVGLTAILMLYTIVIIRGLRTAIATRDSFGKLLAAGLSSTLAIQLFIVVGGVTRLIPLTGLTTPWMSYGGSSLLANYILLAILARISHGARRPLRTRPRNKSPITAAGTEVIERV

SEQ ID NO: 154 - protein, 514 aa, Mycobacterium tuberculosis
VARVTLVLRYAARSDRGLVRANNEDSVYAGARLLALADGMGGHAAGEVASQLVIAALAHLDDDEPGGDLLAKLDAAVRAGNSAIAAQVEMEPDLEGMGTTLTAILFAGNRLGLVHIGDSRGYLLRDGELTQITKDDTFVQTLVDEGRITPEEAHSHPQRSLIMRALTGHEVEPTLTMREARAGDRYLLCSDGLSDPVSDETILEALQIPEVAESAHRLIELALRGGGPDNVTVVVADVVDYDYGQTQPILAGAVSGDDDQLTLPNTAAGRASAISQRKEIVKRVPPQADTFSRPRWSGRRLAFVVALVTVLMTAGLLIGRAIIRSNYYVADYAGSVSIMRGIQGSLLGMSLHQPYLMGCLSPRNELSQISYGQSGGPLDCHLMKLEDLRPPERAQVRAGLPAGTLDDAIGQLRELAANSLLPPCPAPRATSPPGRPAPPTTSETTEPNVTSSPASPSPTTSAPAPTGTTPAIPTSASPAAPASPPTPWPVTSSPTMAALPPPPPQPGIDCRAAA

SEQ ID NO: 155 - protein, 155 aa, Mycobacterium tuberculosis
MQGLVLQLTRAGFLMLLWVFIWSVLRILKTDIYAPTGAVMMRRGLALRGTLLGARQRRHAARYLVVTEGALTGARITLSEQPVLIGRADDSTLVLTDDYASTRHARLSMRGSEWYVEDLGSTNGTYLDRAKVTTAVRVPIGTPVRIGKTAIELRP

SEQ ID NO: 156 - protein, 527 aa, Mycobacterium tuberculosis
MGSQKRLVQRVERKLEQTVGDAFARIFGGSIVPQEVEALLRREAADGIQSLQGNRLLAPNEYIITLGVHDFEKLGADPELKSTGFARDLADYIQEQGWQTYGDVVVRFEQSSNLHTGQFRARGTVNPDVETHPPVIDCARPQSNHAFGAEPGVAPMSDNSSYRGGQGQGRPDEYYDDRYARPQEDPRGGPDPQGGSDPRGGYPPETGGYPPQPGYPRPRHPDQGDYPEQIGYPDQGGYPEQRGYPEQRGYPDQRGYQDQGRGYPDQGQGGYPPPYEQRPPVSPGPAAGYGAPGYDQGYRQSGGYGPSPGGGQPGYGGYGEYGRGPARHEEGSYVPSGPPGPPEQRPAYPDQGGYDQGYQQGATTYGRQDYGGGADYTRYTESPRVPGYAPQGGGYAEPAGRDYDYGQSGAPDYGQPAPGGYSGYGQGGYGSAGTSVTLQLDDGSGRTYQLREGSNIIGRGQDAQFRLPDTGVSRRHLEIRWDGQVALLADLNSTNGTTVNNAPVQEWQLADGDVIRLGHSEIIVRMH

SEQ ID NO: 157 - protein, 771 aa, Mycobacterium tuberculosis
MPTGLGYDFLRPVEDSGINDLKHYYFMADLADGQPLGRANLYSVCFDLATTDRKLTPAWRTTIKRWFPGFMTFRFLECGLLTMVSNPLALRSDTDLERVLPVLAGQMDQLAHDDGSDFLMIRDVDPEHYQRYLDILRPLGFRPALGFSRVDTTISWSSVEEALGCLSHKRRLPLKTSLEFRERFGIEVEELDEYAEHAPVLARLWRNVKTEAKDYQREDLNPEFFAACSRHLHGRSRLWLFRYQGTPIAFFLNVWGADENYILLEWGIDRDFEHYRKANLYRAALMLSLKDAISRDKRRMEMGITNYFTKLRIPGARVIPTIYFLRHSTDPVHTATLARMMMHNIQRPTLPDDMSEEFCRWEERIRLDQDGLPEHDIFRKIDRQHKYTGLKLGGVYGFYPRFTGPQRSTVKAAELGEIVLLGTNSYLGLATHPEVVEASAEATRRYGTGCSGSPLLNGTLDLHVSLEQELACFLGKPAAVLCSTGYQSNLAAISALCESGDMIIQDALNHRSLFDAARLSGADFTLYRHNDMDHLARVLRRTEGRRRIIVVDAVFSMEGTVADLATIAELADRHGCRVYVDESHALGVLGPDGRGASAALGVLARMDVVMGTFSKSFASVGGFIAGDRPVVDYIRHNGSGHVFSASLPPAAAAATHAALRVSRREPDRRARVLAAAEYMATGLARQGYQAEYHGTAIVPVILGNPTVAHAGYLRLMRSGVYVNPVAPPAVPEERSGFRTSYLADHRQSDLDRALHVFAGLAEDLTPQGAAL

SEQ ID NO: 158 - protein, 678 aa, Mycobacterium tuberculosis
VVILLPMVTFTMAYLIVDVPKPGDIRTNQVSTILASDGSEIAKIVPPEGNRVDVNLSQVPMHVRQAVIAAEDRNFYSNPGFSFTGFARAVKNNLFGGDLQGGSTITQQYVKNALVGSAQHGWSGLMRKAKELVIATKMSGEWSKDDVLQAYLNIIYFGRGAYGISAASKAYFDKPVEQLTVAEGALLAALIRRPSTLDPAVDPEGAHARWNWVLDGMVETKALSPNDRAAQVFPETVPPDLARAENQTKGPNGLIERQVTRELLELFNIDEQTLNTQGLVVTTTIDPQAQRAAEKAVAKYLDGQDPDMRAAVVSIDPHNGAVRAYYGGDNANGFDFAQAGLQTGSSFKVFALVAALEQGIGLGYQVDSSPLTVDGIKITNVEGEGCGTCNIAEALKMSLNTSYYRLMLKLNGGPQAVADAAHQAGIASSFPGVAHTLSEDGKGGPPNNGIVLGQYQTRVIDMASAYATLAASGIYHPPHFVQKVVSANGQVLFDASTADNTGDQRIPKAVADNVTAAMEPIAGYSRGHNLAGGRDSAAKTGTTQFGDTTANKDAWMVGYTPSLSTAVWVGTVKGDEPLVTASGAAIYGSGLPSDIWKATMDGALKGTSNETFPKPTEVGGYAGVPPPPPPPEVPPSETVIQPTVEIAPGITIPIGPPTTITLAPPPPAPPAATPTPPP

SEQ ID NO: 159 - protein, 560 aa, Mycobacterium tuberculosis
VTGALSQSSNISPLPLAADLRSADNRDCPSRTDVLGAALANVVGGPVGRHALIGRTRLMTPLRVMFAIALVFLALGWSTKAACLQSTGTGPGDQRVANWDNQRAYYQLCYSDTVPLYGAELLSQGKFPYKSSWIETDSNGTPQLRYDGQIAVRYMEYPVLTGIYQYLSMAIAKTYTALSKVAPLPVVAEVVMFFNVAAFGLALAWLTTVWATSGLAGRRIWDAALVAASPLVIFQIFTNFDALATGLATSGLLAWARRRPVLAGVLIGLGSAAKLYPLLFLYPLLLLGIRAGRLNALARTMAAAAATWLLVNLPVMLLFPRGWSEFFRLNTRRGDDMDSLYNVVKSFTGWRGFDPTLGFWEPPLVLNTVVTLLFVLCCAAIAYIALTAPHRPRVAQLTFLTVASFLLVNKVWSPQFSLWLVPLAVLALPHRRILLAWMTIDALVWVPRMYYLYGNPSRSLPEQWFTTTVLLRDIAVMVLCGLVVWQIYRPGRDLVRTGGPGALPACGGVDDPVGGVFANAADAPPGRLPSWLRPRLGDEHARERTPDAGRDRTFSGQHRA

SEQ ID NO: 160 - protein, 398 aa, Mycobacterium tuberculosis
MRTPVILVAGQDHTDEVTGALLRRTGTVVVEHRFDGHVVRRMTATLSRGELITTEDALEFAHGCVSCTIRDDLLVLLRRLHRRDNVGRIVVHLAPWLEPQPICWAIDHVRVCVGHGYPDGPAALDVRVAAVVTCVDCVRWLPQSLGEDELPDGRTVAQVTVGQAEFADLLVLTHPEPVAVAVLRRLAPRARITGGVDRVELALAHLDDNSRRGRTDTPHTPLLAGLPPLAADGEVAIVEFSARRPFHPQRLHAAVDLLLDGVVRTRGRLWLANRPDQVMWLESAGGGLRVASAGKWLAAMAASEVAYVDLERRLFADLMWVYPFGDRHTAMTVLVCGADPTDIVNALNAALLSDDEMASPQRWQSYVDPFGDWHDDPCHEMPDAAGEFSAHRNSGESR

SEQ ID NO: 161 - protein, 355 aa, Mycobacterium tuberculosis
MSNSRRRSLRWSWLLSVLAAVGLGLATAPAQAAPPALSQDRFADFPALPLDPSAMVAQVGPQVVNINTKLGYNNAVGAGTGIVIDPNGVVLTNNHVIAGATDINAFSVGSGQTYGVDVVGYDRTQDVAVLQLRGAGGLPSAAIGGGVAVGEPVVAMGNSGGQGGTPRAVPGRVVALGQTVQASDSLTGAEETLNGLIQFDAAIQPGDSGGPVVNGLGQVVGMNTAASDNFQLSQGGQGFAIPIGQAMAIAGQIRSGGGSPTVHIGPTAFLGLGVVDNNGNGARVQRVVGSAPAASLGISTGDVITAVDGAPINSATAMADALNGHHPGDVISVTWQTKSGGTRTGNVTLAEGPPA

SEQ ID NO: 162 - protein, 625 aa, Mycobacterium tuberculosis
MARAVGIDLGTTNSVVSVLEGGDPVVVANSEGSRTTPSIVAFARNGEVLVGQPAKNQAVTNVDRTVRSVKRHMGSDWSIEIDGKKYTAPEISARILMKLKRDAEAYLGEDITDAVITTPAYFNDAQRQATKDAGQIAGLNVLRIVNEPTAAALAYGLDKGEKEQRILVFDLGGGTFDVSLLEIGEGVVEVRATSGDNHLGGDDWDQRVVDWLVDKFKGTSGIDLTKDKMAMQRLREAAEKAKIELSSSQSTSINLPYITVDADKNPLFLDEQLTRAEFQRITQDLLDRTRKPFQSVIADTGISVSEIDHVVLVGGSTRMPAVTDLVKELTGGKEPNKGVNPDEVVAVGAALQAGVLKGEVKDVLLLDVTPLSLGIETKGGVMTRLIERNTTIPTKRSETFTTADDNQPSVQIQVYQGEREIAAHNKLLGSFELTGIPPAPRGIPQIEVTFDIDANGIVHVTAKDKGTGKENTIRIQEGSGLSKEDIDRMIKDAEAHAEEDRKRREEADVRNQAETLVYQTEKFVKEQREAEGGSKVPEDTLNKVDAAVAEAKAALGGSDISAIKSAMEKLGQESQALGQAIYEAAQAASQATGAAHPGGEPGGAHPGSADDVVDAEVVDDGREAK

SEQ ID NO: 163 - protein, 235 aa, Mycobacterium tuberculosis
VTDGNQKPDGNSGEQVTVTDKRRIDPETGEVRHVPPGDMPGGTAAADAAHTEDKVAELTADLQRVQADFANYRKRALRDQQAAADRAKASVVSQLLGVLDDLERARKHGDLESGPLKSVADKLDSALTGLGLVAFGAEGEDFDPVLHEAVQHEGDGGQGSKPVIGTVMRQGYQLGEQVLRHALVGVVDTVVVDAAELESVDDGTAVADTAENDQADQGNSADTSGEQAESEPSGS

SEQ ID NO: 164 - protein, 395 aa, Mycobacterium tuberculosis
MAQREWVEKDFYQELGVSSDASPEEIKRAYRKLARDLHPDANPGNPAAGERFKAVSEAHNVLSDPAKRKEYDETRRLFAGGGFGGRRFDSGFGGGFGGFGVGGDGAEFNLNDLFDAASRTGGTTIGDLFGGLFGRGGSARPSRPRRGNDLETETELDFVEAAKGVAMPLRLTSPAPCTNCHGSGARPGTSPKVCPTCNGSGVINRNQGAFGFSEPCTDCRGSGSIIEHPCEECKGTGVTTRTRTINVRIPPGVEDGQRIRLAGQGEAGLRGAPSGDLYVTVHVRPDKIFGRDGDDLTVTVPVSFTELALGSTLSVPTLDGTVGVRVPKGTADGRILRVRGRGVPKRSGGSGDLLVTVKVAVPPNLAGAAQEALEAYAAAERSSGFNPRAGWAGNR

SEQ ID NO: 165 - protein, 344 aa, Mycobacterium tuberculosis [sequence omitted]

SEQ ID NO: 166 - protein, 1402 aa, Mycobacterium tuberculosis
MTDGSVTADKLQKWFREYLSTHIECHPNEVSLDVPIRDLGLKSIDVLAIPGDLGDRFGFCIPDLAVWDNPSANDLIDSLLNQRSADSLRESHGHADRNTQGRGSINEPVAVIGVGCRFPGDIDGPERLWDFLTEKKCAITAYPDRGFTNAGTFAESGGFLKDVAGFDNRFFDIPPDEALRMDPQQRLLLEVSWEALEHAGIIPESLRLSRTGVFVGVSSTDYVRLVSASAQQKSTIWDNTGGSSSIIANRISYFLDIQGPSIVIDTACSSSLVAVHLACRSLSTWDCDIALVGGTNVLISPEPWGGFREAGILSQTGCCHAFDKSADGMVRGEGCGVIVLQRLSDARLEGRRILAILTGSAVNQDGKSNGIMAPNPSAQIGVLENACKSARVDPLEIGYVEAHGTGTSLGDRIEAHALGMVFGRKRPGSGPLMIGSIKPNIGHLEGAAGIAGLIKAVLMVERGSLLPSGGFTEPNPAIPFTELGLRVVDELQEWPVVAGRPRRAGVSSFGFGGTNAHVIVEEAGSVGADTVSGRADVGGSGGGVVAWVISGKTASALAAQAGRLGRYVRARPALDVVDVGYSLVSTRSVFDHRAVVVGQTRDELLAGLAGVVAGRPEAGVVCGVGKPAGKTAFVFAGQGSQWLGMGSELYAAYPVFAEALDAVVDELDRHLRYPLRDVIWGHDQDLLNTTEFAQPALFAVEVALYRLLMSWGVRPGLVLGHSVGELAAAHVAGALCLPDAAMLVAARGRLMQALPAGGAMFAVQAREDEVAPMLGHDVSIAAVNGPASVVISGAHDAVSAIADRLRGQGRRVHRLAVSHAFHSALMEPMIAEFTAVAAELSVGLPTIPVISNVTGQLVADDFASADYWARHIRAVVRFGDSVRSAHCAGASRFIEVGPGGGLTSLIEASLADAQIVSVPTLRKDRPEPVSVMTAAAQGFVSGMGLDWASVFSGYRPKRVELPTYAFQHQKFWLAPAPSVSDPTAAGQIGASDGGAELLASSGFAARLAGRSADEQLAAAIEVVCEHAAAVLGRDGAAGLDAGQAFADSGFNSLSAVELRNRLTAVTAVTLPATAIFDHPTPTELAQYLITQIDGHGSSAAAAANPAERIDALTDLFLQACDAGRDADGWKMVALASNTRERMSSPVRNNVSKNVALLADGISDVVVICIPTLTVLSDQREYRDIANAMTGRHSVYSLTLPGFDSSDALPQNADMIVETVSNAIIDVVGGSCRFVLSGYSSGGVLAYALCSHLSVKHQRNPLGVALIDTYLPSQIANPSMNEGFSPNDTGKGLSREVIRVARMLNRLTATRLTAAATYAAIFQAWEPGRSMAPVLNIVAKDRIATVENLREERINRWRTAAAEAAYSVAEVPGDHFGMMSTSSEAIATEIHDWISGLVRGPHR

SEQ ID NO: 167 - protein, 728 aa, Mycobacterium tuberculosis
VTHPDPARQLTLTARLNTSAVDSRRGVVRLHPNAIAALGIREWDAVSLTGSRTTAAVAGLAAADTAVGTVLLDDVTLSNAGLREGTEVIVSPVTVYGARSVTLSGSTLATQSVPPVTLRQALLGKVMTVGDAVSLLPRDLGPGTSTSAASRALAAAVGISWTSELLTVTGVDPDGPVSVQPNSLVTWGAGVPAAMGTSTAGQVSISSPEIQIEELKGAQPQAAKLTEWLKLALDEPHLLQTLGAGTNLGVLVSGPAGVGKATLVRAVCDGRRLVTLDGPEIGALAAGDRVKAVASAVQAVRHEGGVLLITDADALLPAAAEPVASLILSELRTAVATAGVVLIATSARPDQLDARLRSPELCDRELGLPLPDAATRKSLLEALLNPVPTGDLNLDEIASRTPGFVVADLAALVREAALRAASRASADGRPPMLHQDDLLGALTVIRPLSRSASDEVTVGDVTLDDVGDMAAAKQALTEAVLWPLQHPDTFARLGVEPPRGVLLYGPPGCGKTFVVRALASTGQLSVHAVKGSELMDKWVGSSEKAVRELFRRARDSAPSLVFLDELDALAPRRGQSFDSGVSDRVVAALLTELDGIDPLRDVVMLGATNRPDLIDPALLRPGRLERLVFVEPPDAAARREILRTAGKSIPLSSDVDLDEVAAGLDGYSAADCVALLREAALTAMRRSIDAANVTAADLATARETVRASLDPLQVASLRKFGTKGDLRS

SEQ ID NO: 168 - protein, 286 aa, Mycobacterium tuberculosis
MIGKPRGRRGVNLQILPSAMTVLSICAGLTAIKFALEHQPKAAMALIAAAAILDGLDGRVARILDAQSRMGAEIDSLADAVNFGVTPALVLYVSMLSKWPVGWVVVLLYAVCVVLRLARYNALQDDGTQPAYAHEFFVGMPAPAGAVSMIGLLALKMQFGEGWWTSGWFLSFWVTGTSILLVSGIPMKKMHAVSVPPNYAAALLAVLAICAAAAVLAPYLLIWVIIIAYMCHIPFAVRSQRWLAQHPEVWDDKPKQRRAVRRASRRAHPYRPSMARLGLRKPGRRL

SEQ ID NO: 169 - protein, 540 aa, Mycobacterium tuberculosis
MAKTIAYDEEARRGLERGLNALADAVKVTLGPKGRNVVLEKKWGAPTITNDGVSIAKEIELEDPYEKIGAELVKEVAKKTDDVAGDGTTTATVLAQALVREGLRNVAAGANPLGLKRGIEKAVEKVTETLLKGAKEVETKEQIAATAAISAGDQSIGDLIAEAMDKVGNEGVITVEESNTFGLQLELTEGMRFDKGYISGYFVTDPERQEAVLEDPYILLVSSKVSTVKDLLPLLEKVIGAGKPLLIIAEDVEGEALSTLVVNKIRGTFKSVAVKAPGFGDRRKAMLQDMAILTGGQVISEEVGLTLENADLSLLGKARKVVVTKDETTIVEGAGDTDAIAGRVAQIRQEIENSDSDYDREKLQERLAKLAGGVAVIKAGAATEVELKERKHRIEDAVRNAKAAVEEGIVAGGGVTLLQAAPTLDELKLEGDEATGANIVKVALEAPLKQIAFNSGLEPGVVAEKVRNLPAGHGLNAQTGVYEDLLAAGVADPVKVTRSALQNAASIAGLFLTTEAVVADKPEKEKASVPGGGDMGGMDF

SEQ ID NO: 170 - protein, 369 aa, Mycobacterium tuberculosis
MKRSGVGSLFAGAHIAEAVPLAPLTTLRVGPIARRVITCTSAEQVVAALRHLDSAAKTGADRPLVFAGGSNLVIAENLTDLTVVRLANSGITIDGNLVRAEAGAVFDDVVVRAIEQGLGGLECLSGIPGSAGATPVQNVGAYGAEVSDTITRVRLLDRCTGEVRWVSARDLRFGYRTSVLKHADGLAVPTVVLEVEFALDPSGRSAPLRYGELIAALNATSGERADPQAVREAVLALRARKGMVLDPTDHDTWSVGSFFTNPVVTQDVYERLAGDAATRKDGPVPHYPAPDGVKLAAGWLVERAGFGKGYPDAGAAPCRLSTKHALALTNRGGATAEDVVTLARAVRDGVHDVFGITLKPEPVLIGCML

SEQ ID NO: 171 - protein, 451 aa, Mycobacterium tuberculosis
VVIRVLFRPVSLIPVNNSSTPQSQGPISRRLALTALGFGVLAPNVLVACAGKVTKLAEKRPPPAPRLTFRPADSAADVVPIAPISVEVGDGWFQRVALTNSAGKVVAGAYSRDRTIYTITEPLGYDTTYTWSGSAVGHDGKAVPVAGKFTTVAPVKTINAGFQLADGQTVGIAAPVIIQFDSPISDKAAVERALTVTTDPPVEGGWAWLPDEAQGARVHWRPREYYPAGTTVDVDAKLYGLPFGDGAYGAQDMSLHFQIGRRQVVKAEVSSHRIQVVTDAGVIMDFPCSYGEADLARNVTRNGIHVVTEKYSDFYMSNPAAGYSHIHERWAVRISNNGEFIHANPMSAGAQGNSNVTNGCINLSTENAEQYYRSAVYGDPVEVTGSSIQLSYADGDIWDWAVDWDTWVSMSALPPPAAKPAATQIPVTAPVTPSDAPTPSGTPTTTNGPGG

SEQ ID NO: 172 - protein, 249 aa, Mycobacterium tuberculosis
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRG

SEQ ID NO: 173 - protein, 410 aa, Mycobacterium tuberculosis
VTVFSALLLAGVLSALALAVGGAVGMRLTSRVVEQRQRVATEWSGITVSQMLQCIVTLMPLGAAVVDTHRDVVYLNERAKELGLVRDRQLDDQAWRAARQALGGEDVEFDLSPRKRSATGRSGLSVHGHARLLSEEDRRFAVVFVHDQSDYARMEAARRDFVANVSHELKTPVGAMALLAEALLASADDSETVRRFAEKVLIEANRLGDMVAELIELSRLQGAERLPNMTDVDVDTIVSEAISRHKVAADNADIEVRTDAPSNLRVLGDQTLLVTALANLVSNAIAYSPRGSLVSISRRRRGANIEIAVTDRGIGIAPEDQERVFERFFRGDKARSRATGGSGLGLAIVKHVAANHDGTIRVWSKPGTGSTFTLALPALIEAYHDDERPEQAREPELRSNRSQREEELSR

SEQ ID NO: 174 - protein, 295 aa, Mycobacterium tuberculosis
MLFGMARIAIIGGGSIGEALLSGLLRAGRQVKDLVVAERMPDRANYLAQTYSVLVTSAADAVENATFVVVAVKPADVEPVIADLANATAAAENDSAEQVFVTVVAGITIAYFESKLPAGTPVVRAMPNAAALVGAGVTALAKGRFVTPQQLEEVSALFDAVGGVLTVPESQLDAVTAVSGSGPAYFFLLVEALVDAGVGVGLSRQVATDLAAQTMAGSAAMLLERMEQDQGGANGELMGLRVDLTASRLRAAVTSPGGTTAAALRELERGGFRMAVDAAVQAAKSRSEQLRITPE

SEQ ID NO: 175 - protein, 529 aa, Mycobacterium tuberculosis
MWRSLTSMGTALVLLFLLALAAIPGALLPQRGLNAAKVDDYLAAHPLIGPWLDELQAFDVFSSFWFTAIYVLLFVSLVGCLAPRTIEHARSLRATPVAAPRNLARLPKHAHARLAGEPAALAATITGRLRGWRSITRQQGDSVEVSAEKGYLREFGNLVFHFALLGLLVAVAVGKLFGYEGNVIVIADGGPGFCSASPAAFDSFRAGNTVDGTSLHPICVRVNNFQAHYLPSGQATSFAADIDYQADPATADLIANSWRPYRLQVNHPLRVGGDRVYLQGHGYAPTFTVTFPDGQTRTSTVQWRPDNPQTLLSAGVVRIDPPAGSYPNPDERRKHQIAIQGLLAPTEQLDGTLLSSRFPALNAPAVAIDIYRGDTGLDSGRPQSLFTLDHRLIEQGRLVKEKRVNLRAGQQVRIDQGPAAGTVVRFDGAVPFVNLQVSHDPGQSWVLVFAITMMAGLLVSLLVRRRRVWARITPTTAGTVNVELGGLTRTDNSGWGAEFERLTGRLLAGFEARSPDMAEAAAGTGRDVD

SEQ ID NO: 176 - protein, 1172 aa, Mycobacterium tuberculosis
LADSRQSKTAASPSPSRPQSSSNNSVPGAPNRVSFAKLREPLEVPGLLDVQTDSFEWLIGSPRWRESAAERGDVNPVGGLEEVLYELSPIEDFSGSMSLSFSDPRFDDVKAPVDECKDKDMTYAAPLFVTAEFINNNTGEIKSQTVFMGDFPMMTEKGTFIINGTERVVVSQLVRSPGVYFDETIDKSTDKTLHSVKVIPSRGAWLEFDVDKRDTVGVRIDRKRRQPVTVLLKALGWTSEQIVERFGFSEIMRSTLEKDNTVGTDEALLDIYRKLRPGEPPTKESAQTLLENLFFKEKRYDLARVGRYKVNKKLGLHVGEPITSSTLTEEDVVATIEYLVRLHEGQTTMTVPGGVEVPVETDDIDHFGNRRLRTVGELIQNQIRVGMSRMERVVRERMTTQDVEAITPQTLINIRPVVAAIKEFFGTSQLSQFMDQNNPLSGLTHKRRLSALGPGGLSRERAGLEVRDVHPSHYGRMCPIETPEGPNIGLIGSLSVYARVNPFGFIETPYRKVVDGVVSDEIVYLTADEEDRHVVAQANSPIDADGRFVEPRVLVRRKAGEVEYVPSSEVDYMDVSPRQMVSVATAMIPFLEHDDANRALMGANMQRQAVPLVRSEAPLVGTGMELRAAIDAGDVVVAEESGVIEEVSADYITVMHDNGTRRTYRMRKFARSNHGTCANQCPIVDAGDRVEAGQVIADGPCTDDGEMALGKNLLVAIMPWEGHNYEDAIILSNRLVEEDVLTSIHIEEHEIDARDTKLGAEEITRDIPNISDEVLADLDERGIVRIGAEVRDGDILVGKVTPKGETELTPEERLLRAIFGEKAREVRDTSLKVPHGESGKVIGIRVFSREDEDELPAGVNELVRVYVAQKRKISDGDKLAGRHGNKGVIGKILPVEDMPFLADGTPVDIILNTHGVPRRMNIGQILETHLGWCAHSGWKVDAAKGVPDWAARLPDELLEAQPNAIVSTPVFDGAQEAELQGLLSCTLPNRDGDVLVDADGKAMLFDGRSGEPFPYPVTVGYMYIMKLHHLVDDKIHARSTGPYSMITQQPLGGKAQFGGQRFGEMECWAMQAYGAAYTLQELLTIKSDDTVGRVKVYEAIVKGENIPEPGIPESFKVLLKELQSLCLNVEVLSSDGAAIELREGEDEDLERAAANLGINLSRNESASVEDLA

SEQ ID NO: 177 - protein, 1316 aa, Mycobacterium tuberculosis
VLDVNFFDELRIGLATAEDIRQWSYGEVKKPETINYRTLKPEKDGLFCEKIFGPTRDWECYCGKYKRVRFKGIICERCGVEVTRAKVRRERMGHIELAAPVTHIWYFKGVPSRLGYLLDLAPKDLEKIIYFAAYVITSVDEEMRHNELSTLEAEMAVERKAVEDQRDGELEARAQKLEADLAELEAEGAKADARRKVRDGGEREMRQIRDRAQRELDRLEDIWSTFTKLAPKQLIVDENLYRELVDRYGEYFTGAMGAESIQKLIENFDIDAEAESLRDVIRNGKGQKKLRALKRLKVVAAFQQSGNSPMGMVLDAVPVIPPELRPMVQLDGGRFATSDLNDLYRRVINRNNRLKRLIDLGAPEIIVNNEKRMLQESVDALFDNGRRGRPVTGPGNRPLKSLSDLLKGKQGRFRQNLLGKRVDYSGRSVIVVGPQLKLHQCGLPKLMALELFKPFVMKRLVDLNHAQNIKSAKRMVERQRPQVWDVLEEVIAEHPVLLNRAPTLHRLGIQAFEPMLVEGKAIQLHPLVCEAFNADFDGDQMAVHLPLSAEAQAEARILMLSSNNILSPASGRPLAMPRLDMVTGLYYLTTEVPGDTGEYQPASGDHPETGVYSSPAEAIMAADRGVLSVRAKIKVRLTQLRPPVEIEAELFGHSGWQPGDAWMAETTLGRVMFNELLPLGYPFVNKQMHKKVQAAIINDLAERYPMIVVAQTVDKLKDAGFYWATRSGVTVSMADVLVPPRKKEILDHYEERADKVEKQFQRGALNHDERNEALVEIWKEATDEVGQALREHYPDDNPIITIVDSGATGNFTQTRTLAGMKGLVTNPKGEFIPRPVKSSFREGLTVLEYFINTHGARKGLADTALRTADSGYLTRRLVDVSQDVIVREHDCQTERGIVVELAERAPDGTLIRDPYIETSAYARTLGTDAVDEAGNVIVERGQDLGDPEIDALLAAGITQVKVRSVLTCATSTGVCATCYGRSMATGKLVDIGEAVGIVAAQSIGEPGTQLTMRTFHQGGVGEDITGGLPRVQELFEARVPRGKAPIADVTGRVRLEDGERFYKITIVPDDGGEEVVYDKISKRQRLRVFKHEDGSERVLSDGDHVEVGQQLMEGSADPHEVLRVQGPREVQIHLVREVQEVYRAQGVSIHDKHIEVIVRQMLRRVTIIDSGSTEFLPGSLIDRAEFEAENRRVVAEGGEPAAGRPVLMGITKASLATDSWLSAASFQETTRVLTDAAINCRSDKLNGLKENVIIGKLIPAGTGINRYRNIAVQPTEEARAAAYTIPSYEDQYYSPDFGAATGAAVPLDDYGYSDYR

SEQ ID NO: 178 - protein, 787 aa, Mycobacterium tuberculosis
MAPEATEAFNGTIELDIRDSEPDWGPYAAPVAPEHSPNILYLVWDDVGIATWDCFGGLVEMPAMTRVAERGVRLSQFHTTALCSPTRASLLTGRNATTVGMATIEEFTDGFPNCNGRIPADTALLPEVLAEHGYNTYCVGKWHLTPLEESNMASTKRHWPTSRGFERFYGFLGGETDQWYPDLVYDNHPVSPPGTPEGGYHLSKDIADKTIEFIRDAKVIAPDKPWFSYVCPGAGHAPHHVFKEWADRYAGRFDMGYERYREIVLERQKALGIVPPDTELSPINPYLDVPGPNGETWPLQDTVRPWDSLSDEEKKLFCRMAEVFAGFLSYTDAQIGRILDYLEESGQLDNTIIVVISDNGASGEGGPNGSVNEGKFFNGYIDTVAESMKLFDHLGGPQTYNHYPIGWAMAFNTPYKLFKRYASHEGGIADPAIISWPNGIAAHGEIRDNYVNVSDITPTVYDLLGMTPPGTVKGIPQKPMDGVSFIAALADPAADTGKTTQFYTMLGTRGIWHEGWFANTIHAATPAGWSNFNADRWELFHIAADRSQCHDLAAEHPDKLEELKALWFSEAAKYNGLPLADLNLLETMTRSRPYLVSERASYVYYPDCADVGIGAAVEIRGRSFAVLADVTIDTTGAEGVLFKHGGAHGGHVLFVRDGRLHYVYNFLGERQQLVSSSGPVPSGRHLLGVRYLRTGTVPNSHTPVGDLELFFDENLVGALTNVLTHPGTFGLAGAAISVGRNGGSAVSSHYEAPFAFTGGTITQVTVDVSGRPFEDVESDLALAFSRD

SEQ ID NO: 179 - protein, 451 aa, Mycobacterium tuberculosis
MSAVALPRVSGGHDEHGHLEEFRTDPIGLMQRVRDECGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPACVRYRRRTGV

SEQ ID NO: 180 - protein, 542 aa, Mycobacterium tuberculosis
VQSDKTVLLEVDHELAGAARAAIAPFAELERAPEHVHTYRITPLALWNARAAGHDAEQVVDALVSYSRYAVPQPLLVDIVDTMARYGRLQLVKNPAHGLTLVSLDRAVLEEVLRNKKIAPMLGARIDDDTVVVHPSERGRVKQLLLKIGWPAEDLAGYVDGEAHPISLHQEGWQLRDYQRLAADSFWAGGSGVVVLPCGAGKTLVGAAAMAKAGATTLILVTNIVAARQWKRELVARTSLTENEIGEFSGERKEIRPVTISTYQMITRRTKGEYRHLELFDSRDWGLIIYDEVHLLPAPVFRMTADLQSKRRLGLTATLIREDGREGDVFSLIGPKRYDAPWKDIEAQGWIAPAECVEVRVTMTDSERMMYATAEPEERYRICSTVHTKIAVVKSILAKHPDEQTLVIGAYLDQLDELGAELGAPVIQGSTRTSEREALFDAFRRGEVATLVVSKVANFSIDLPEAAVAVQVSGTFGSRQEEAQRLGRILRPKADGGGAIFYSVVARDSLDAEYAAHRQRFLAEQGYGYIIRDADDLLGPAI

SEQ ID NO: 181 - protein, 495 aa, Mycobacterium tuberculosis
VSRITTDQLRHAVLDRGSFVSWDSEPLAVPVADSYARELAAARAATGADESVQTGEGRVFGRRVAVVACEFDFLGGSIGVAAAERITAAVERATAERLPLLASPSSGGTRMQEGTVAFLQMVKIAAAIQLHNQARLPYLVYLRHPTTGGVFASWGSLGHLTVAEPGALIGFLGPRVYELLYGDPFPSGVQTAENLRRHGIIDGVVALDRLRPMLDRALTVLIDAPEPLPAPQTPAPVPDVPTWDSVVASRRPDRPGVRQLLRHGATDRVLLSGTDQGEAATTLLALARFGGQPTVVLGQQRAVGGGGSTVGPAALREARRGMALAAELCLPLVLVIDAAGPALSAAAEQGGLAGQIAHCLAELVTLDTPTVSILLGQGSGGPALAMLPADRVLAALHGWLAPLPPEGASAIVFRDTAHAAELAAAQGIRSADLLKSGIVDTIVPEYPDAADEPIEFALRLSNAIAAEVHALRKIPAPERLATRLQRYRRIGLPRD

SEQ ID NO: 182 - protein, 464 aa, Mycobacterium tuberculosis
MAKLARVVGLVQEEQPSDMTNHPRYSPPPQQPGTPGYAQGQQQTYSQQFDWRYPPSPPPQPTQYRQPYEALGGTRPGLIPGVIPTMTPPPGMVRQRPRAGMLAIGAVTIAVVSAGIGGAAASLVGFNRAPAGPSGGPVAASAAPSIPAANMPPGSVEQVAAKVVPSVVMLETDLGRQSEEGSGIILSAEGLILTNNHVIAAAAKPPLGSPPPKTTVTFSDGRTAPFTVVGADPTSDIAVVRVQGVSGLTPISLGSSSDLRVGQPVLAIGSPLGLEGTVTTGIVSALNRPVSTTGEAGNQNTVLDAIQTDAAINPGNSGGALVNMNAQLVGVNSAIATLGADSADAQSGSIGLGFAIPVDQAKRIADELISTGKASHASLGVQVTNDKDTLGAKIVEVVAGGAAANAGVPKGVVVTKVDDRPINSADALVAAVRSKAPGATVALTFQDPSGGSRTVQVTLGKAEQ

SEQ ID NO: 183 - protein, 264 aa, Mycobacterium tuberculosis
LVDAHTHLDACGARDADTVRSLVERAAAAGVTAVVTVADDLESARWVTRAAEWDRRVYAAVALHPTRADALTDAARAELERLVAHPRVVAVGETGIDMYWPGRLDGCAEPHVQREAFAWHIDLAKRTGKPLMIHNRQADRDVLDVLRAEGAPDTVILHCFSSDAAMARTCVDAGWLLSLSGTVSFRTARELREAVPLMPVEQLLVETDAPYLTPHPHRGLANEPYCLPYTVRALAELVNRRPEEVALITTSNARRAYGLGWMRQ

SEQ ID NO: 184 - protein, 362 aa, Mycobacterium tuberculosis
MLRLVVGALLLVLAFAGGYAVAACKTVTLTVDGTAMRVTTMKSRVIDIVEENGFSVDDRDDLYPAAGVQVHDADTIVLRRSRPLQISLDGHDAKQVWTTASTVDEALAQLAMTDTAPAAASRASRVPLSGMALPVVSAKTVQLNDGGLVRTVHLPAPNVAGLLSAAGVPLLQSDHVVPAATAPIVEGMQIQVTRNRIKKVTERLPLPPNARRVEDPEMNMSREVVEDPGVPGTQDVTFAVAEVNGVETGRLPVANVVVTPAHEAVVRVGTKPGTEVPPVIDGSIWDAIAGCEAGGNWAINTGNGYYGGVQFDQGTWEANGGLRYAPRADLATREEQIAVAEVTRLRQGWGAWPVCAARAGAR

SEQ ID NO: 185 - protein, 317 aa, Mycobacterium tuberculosis
MCCTSGCALTIRLLGRTEIRRLAKELDFRPRKSLGQNFVHDANTVRRVVAASGVSRSDLVLEVGPGLGSLTLALLDRGATVTAVEIDPLLASRLQQTVAEHSHSEVHRLTVVNRDVLALRREDLAAAPTAVVANLPYNVAVPALLHLLVEFPSIRVVTVMVQAEVAERLAAEPGSKEYGVPSVKLRFFGRVRRCGMVSPTVFWPIPRVYSGLVRIDRYETSPWPTDDAFRRRVFELVDIAFAQRRKTSRNAFVQWAGSGSESANRLLAASIDPARRGETLSIDDFVRLLRRSGGSDEATSTGRDARAPDISGHASAS

SEQ ID NO: 186 - protein, 306 aa, Mycobacterium tuberculosis
VPTGSVTVRVPGKVNLYLAVGDRREDGYHELTTVFHAVSLVDEVTVRNADVLSLELVGEGADQLPTDERNLAWQAAELMAEHVGRAPDVSIMIDKSIPVAGGMAGGSADAAAVLVAMNSLWELNVPRRDLRMLAARLGSDVPFALHGGTALGTGRGEELATVLSRNTFHWVLAFADSGLLTSAVYNELDRLREVGDPPRLGEPGPVLAALAAGDPDQLAPLLGNEMQAAAVSLDPALARALRAGVEAGALAGIVSGSGPTCAFLCTSASSAIDVGAQLSGAGVCRTVRVATGPVPGARVVSAPTEV

SEQ ID NO: 187 - protein, 370 aa, Mycobacterium tuberculosis
MLRRMGDASLTTELGRVLVTGGAGFVGANLVTTLLDRGHWVRSFDRAPSLLPAHPQLEVLQGDITDADVCAAAVDGIDTIFHTAAIIELMGGASVTDEYRQRSFAVNVGGTENLLHAGQRAGVQRFVYTSSNSVVMGGQNIAGGDETLPYTDRFNDLYTETKVVAERFVLAQNGVDGMLTCAIRPSGIWGNGDQTMFRKLFESVLKGHVKVLVGRKSARLDNSYVHNLIHGFILAAAHLVPDGTAPGQAYFINDAEPINMFEFARPVLEACGQRWPKMRISGPAVRWVMTGWQRLHFRFGFPAPLLEPLAVERLYLDNYFSIAKARRDLGYEPLFTTQQALTECLPYYVSLFEQMKNEARAEKTAATVKP

SEQ ID NO: 188 - protein, 335 aa, Mycobacterium tuberculosis
MVPTVDMGIPGASVSSRSVADRPNRKRVLLAEPRGYCAGVDRAVETVERALQKHGPPVYVRHEIVHNRHVVDTLAKAGAVFVEETEQVPEGAIVVFSAHGVAPTVHVSASERNLQVIDATCPLVTKVHNEARRFARDDYDILLIGHEGHEEVVGTAGEAPDHVQLVDGVDAVDQVTVRDEDKVVWLSQTTLSVDETMEIVGRLRRRFPKLQDPPSDDICYATQNRQVAVKAMAPECELVIVVGSRNSSNSVRLVEVALGAGARAAHLVDWADDIDSAWLDGVTTVGVTSGASVPEVLVRGVLERLAECGYDIVQPVTTANETLVFALPRELRSPR

SEQ ID NO: 189 - protein, 224 aa, Mycobacterium tuberculosis
MHIGLKIFIWGVLGLVVFGALLFGPAGTFDYWQAWVFLAAFVSTTIGPTIYLARNDPAALQRRMRSGPLAEGRTIQKFIVIGAFLGFFAMMVLSACDHRYGWSSVPAAVCVIGDVLVMTGLGIAMLVVIQNRYAASTVRVEAGQILASDGLYKIVRHPMYAGNVVMMTGIPLALGSYWAMFILVPGTLVLVFRILDEEKLLTQELSGYREYRQLVRYRLVPYVW

SEQ ID NO: 190 - protein, 549 aa, Mycobacterium tuberculosis
VSHLSQRMAGLLRVHGEWSRSVDTRVDTDNAMPARFSAQIQNEDEVTSDQGNNGGPNGGGRLAPRPVFRPPVDPASRQAFGRPSGVQGSFVAERVRPQKYQDQSDFTPNDQLADPVLQEAFGRPFAGAESLQRHPIDAGALAAEKDGAGPDEPDDPWRDPAAAAALGTPALAAPAPHGALAGSGKLGVRDVLFGGKVSYLALGILVAIALVIGGIGGVIGRKTAEVVDAFTTSKVTLSTTGNAQEPAGRFTKVAAAVADSVVTIESVSDQEGMQGSGVIVDGRGYIVTNNHVISEAANNPSQFKTTVVFNDGKEVPANLVGRDPKTDLAVLKVDNVDNLTVARLGDSSKVRVGDEVLAVGAPLGLRSTVTQGIVSALHRPVPLSGEGSDTDTVIDAIQTDASINHGNSGGPLIDMDAQVIGINTAGKSLSDSASGLGFAIPVNEMKLVANSLIKDGKIVHPTLGISTRSVSNAIASGAQVANVKAGSPAQKGGILENDVIVKVGNRAVADSDEFVVAVRQLAIGQDAPIEVVREGRHVTLTVKPDPDST

SEQ ID NO: 191 - protein, 131 aa, Mycobacterium tuberculosis
VFANIGWWEMLVLVMVGLVVLGPERLPGAIRWAASALRQARDYLSGVTSQLREDIGPEFDDLRGHLGELQKLRGMTPRAALTKHLLDGDDSLFTGDFDRPTPKKPDAAGSAGPDATEQIGAGPIPFDSDAT

SEQ ID NO: 192 - protein, 390 aa, Mycobacterium tuberculosis
MPSRLHSAVMSGTRDGDLNAAIRTALGKVIDPELRRPITELGMVKSIDTGPDGSVHVEIYLTIAGCPKKSEITERVTRAVADVPGTSAVRVSLDVMSDEQRTELRKQLRGDTREPVIPFAQPDSLTRVYAVASGKGGVGKSTVTVNLAAAMAVRGLSIGVLDADIHGHSIPRMMGTTDRPTQVESMILPPIAHQVKVISIAQFTQGNTPVVWRGPMLHRALQQFLADVYWGDLDVLLLDLPPGTGDVAISVAQLIPNAELLVVTTPQLAAAEVAERAGSIALQTRQRIVGVVENMSGLTLPDGTTMQVFGEGGGRLVAERLSRAVGADVPLLGQIPLDPALVAAGDSGVPLVLSSPDSAIGKELHSIADGLSTRRRGLAGMSLGLDPTRR

SEQ ID NO: 193 - protein, 366 aa, Mycobacterium tuberculosis
VFPGFDALPEVLRPVARPQPPNAHPVAQPPAQALVDCGVYVCGQRLPGKYTYAAALREVREIELTGQEAFVWIGLHEPDENQMQDVADVFGLHPLAVEDAVHAHQRPKLERYDETLFLVLKTVNYVPHESVVLAREIVKTGEIMIFVGKDFVVTVRHGEHGGLSEVRKRMDADPEHLRLGPYAVMHAIADYVVDHYLEVTNLMETDIDSIEEVAFAPGRKLDIEPIYLLKREVVELRRCVNPLSTAFQRMQTESKDLISKEVRRYLRDVADHQTEAADQIASYDDMLNSLVQAALARVGMQQNMDMRKISAWAGIIAVPTMIAGIYGMNFHFMPELDSRWGYPTVIGGMVLICLFLYHVFRNRNWL

SEQ ID NO: 194 - protein, 528 aa, Mycobacterium tuberculosis
MDTQSDYVVVGTGSAGAVVASRLSTDPATTVVALEAGPRDKNRFIGVPAAFSKLFRSEIDWDYLTEPQPELDGREIYWPRGKVLGGSSSMNAMMWVRGFASDYDEWAARAGPRWSYADVLGYFRRIENVTAAWHFVSGDDSGVTGPLHISRQRSPRSVTAAWLAAARECGFAAARPNSPRPEGFCETVVTQRRGARFSTADAYLKPAMRRKNLRVLTGATATRVVIDGDRAVGVEYQSDGQTRIVYARREVVLCAGAVNSPQLLMLSGIGDRDHLAEHDIDTVYHAPEVGCNLLDHLVTVLGFDVEKDSLFAAEKPGQLISYLLRRRGMLTSNVGEAYGFVRSRPELKLPDLELIFAPAPFYDEALVPPAGHGVVFGPILVAPQSRGQITLRSADPHAKPVIEPRYLSDLGGVDRAAMMAGLRICARIAQARPLRDLLGSIARPRNSTELDEATLELALATCSHTLYHPMGTCRMGSDEASVVDPQLRVRGVDGLRVADASVMPSTVRGHTHAPSVLIGEKAADLIRS

SEQ ID NO: 195 - protein, 441 aa, Mycobacterium tuberculosis
VPGDEKPVGVAVLGLGNVGSEVVRIIENSAEDLAARVGAPLVLRGIGVRRVTTDRGVPIELLTDDIEELVAREDVDIVVEVMGPVEPSRKAILGALERGKSVVTANKALLATSTGELAQAAESAHVDLYFEAAVAGAIPVIRPLTQSLAGDTVLRVAGIVNGTTNYILSAMDSTGADYASALADASALGYAEADPTADVEGYDAAAKAAILASIAFHTRVTADDVYREGITKVTPADFGSAHALGCTIKLLSICERITTDEGSQRVSARVYPALVPLSHPLAAVNGAFNAVVVEAEAAGRLMFYGQGAGGAPTASAVTGDLVMAARNRVLGSRGPRESKYAQLPVAPMGFIETRYYVSMNVADKPGVLSAVAAEFAKREVSIAEVRQEGVVDEGGRRVGARIVVVTHLATDAALSETVDALDDLDVVQGVSSVIRLEGTGL

SEQ ID NO: 196 - protein, 389 aa, Mycobacterium tuberculosis
VIVAGARTPIGKLMGSLKDFSASELGAIAIKGALEKANVPASLVEYVIMGQVLTAGAGQMPARQAAVAAGIGWDVPALTINKMCLSGIDAIALADQLIRAREFDVVVAGGQESMTKAPHLLMNSRSGYKYGDVTVLDHMAYDGLHDVFTDQPMGALTEQRNDVDMFTRSEQDEYAAASHQKAAAAWKDGVFADEVIPVNIPQRTGDPLQFTEDEGIRANTTAAALAGLKPAFRGDGTITAGSASQISDGAAAVVVMNQEKAQELGLTWLAEIGAHGVVAGPDSTLQSQPANAINKALDREGISVDQLDVVEINEAFAAVALASIRELGLNPQIVNVNGGAIAVGHPLGMSGTRITLHAALQLARRGSGVGVAALCGAGGQGDALILRAG

SEQ ID NO: 197 - protein, 208 aa, Mycobacterium tuberculosis
VSVGEGPDTKPTARGQPAAVGRVVVLSGPSAVGKSTVVRCLRERIPNLHFSVSATTRAPRPGEVDGVDYHFIDPTRFQQLIDQGELLEWAEIHGGLHRSGTLAQPVRAAAATGVPVLIEVDLAGARAIKKTMPEAVTVFLAPPSWQDLQARLIGRGTETADVIQRRLDTARIELAAQGDFDKVVVNRRLESACAELVSLLVGTAPGSP

SEQ ID NO: 198 - protein, 457 aa, Mycobacterium tuberculosis
MTPRSRGPRRRPLDPARRAAFETLRAVSARDAYANLVLPALLAQRGIGGRDAAFATELTYGTCRARGLLDAVIGAAAERSPQAIDPVLLDLLRLGTYQLLRTRVDAHAAVSTTVEQAGIEFDSARAGFVNGVLRTIAGRDERSWVGELAPDAQNDPIGHAAFVHAHPRWIAQAFADALGAAVGELEAVLASDDERPAVHLAARPGVLTAGELARAVRGTVGRYSPFAVYLPRGDPGRLAPVRDGQALVQDEGSQLVARALTLAPVDGDTGRWLDLCAGPGGKTALLAGLGLQCAARVTAVEPSPHRADLVAQNTRGLPVELLRVDGRHTDLDPGFDRVLVDAPCTGLGALRRRPEARWRRQPADVAALAKLQRELLSAAIALTRPGGVVLYATCSPHLAETVGAVADALRRHPVHALDTRPLFEPVIAGLGEGPHVQLWPHRHGTDAMFAAALRRLT

SEQ ID NO: 199 - protein, 339 aa, Mycobacterium tuberculosis
MNVEQVKSIDEAMGLAIEHSYQVKGTTYPKPPVGAVIVDPNGRIVGAGGTEPAGGDHAEVVALRRAGGLAAGAIVVVTMEPCNHYGKTPPCVNALIEARVGTVVYAVADPNGIAGGGAGRLSAAGLQVRSGVLAEQVAAGPLREWLHKQRTGLPHVTWKYATSIDGRSAAADGSSQWISSEAARLDLHRRRAIADAILVGTGTVLADDPALTARLADGSLAPQQPLRVVVGKRDIPPEARVLNDEARTMMIRTHEPMEVLRALSDRTDVLLEGGPTLAGAFLRAGAINRILAYVAPILLGGPVTAVDDVGVSNITNALRWQFDSVEKVGPDLLLSLVAR

SEQ ID NO: 200 - protein, 117 aa, Mycobacterium tuberculosis
VAGVTAAVSARLKADEARRPGFYAAGSGPLPQVRGSTLPVMELALQITLIVTSVLVVLLVLLHRAKGGGLSTLFGGGVQSSLSGSTVVEKNLDRLTLFVTGIWLVSIIGVALLIKYR

SEQ ID NO: 201 - protein, 269 aa, Mycobacterium tuberculosis [sequence omitted]

SEQ ID NO: 202 - protein, 472 aa, Mycobacterium tuberculosis
VTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLEKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 203 - protein, 481 aa, Mycobacterium tuberculosis
MPSPTVTSPQVAVNDIGSSEDFLAAIDKTIKYFNDGDIVEGTIVKVDRDEVLLDIGYKTEGVIPARELSIKHDVDPNEVVSVGDEVEALVLTKEDKEGRLILSKKRAQYERAWGTIEALKEKDEAVKGTVIEVVKGGLILDIGLRGFLPASLVEMRRVRDLQPYIGKEIEAKIIELDKNRNNVVLSRRAWLEQTQSEVRSEFLNNLQKGTIRKGVVSSIVNFGAFVDLGGVDGLVHVSELSWKHIDHPSEVVQVGDEVTVEVLDVDMDRERVSLSLKATQEDPWRHFARTHAIGQIVPGKVTKLVPFGAFVRVEEGIEGLVHISELAERHVEVPDQVVAVGDDAMVKVIDIDLERRRISLSLKQANEDYTEEFDPAKYGMADSYDEQGNYIFPEGFDAETNEWLEGFEKQRAEWEARYAEAERRHKMHTAQMEKFAAAEAAGRGADDQSSASSAPSEKTAGGSLASDAQLAALREKLAGSA

SEQ ID NO: 204 - protein, 407 aa, Mycobacterium tuberculosis
MLRIGLTGGIGAGKSLLSTTFSQCGGIVVDGDVLAREVVQPGTEGLASLVDAFGRDILLADGALDRQALAAKAFRDDESRGVLNGIVHPLVARRRSEIIAAVSGDAVVVEDIPLLVESGMAPLFPLVVVVHADVELRVRRLVEQRGMAEADARARIAAQASDQQRRAVADVWLDNSGSPEDLVRRARDVWNTRVQPFAHNLAQRQIARAPARLVPADPSWPDQARRIVNRLKIACGHKALRVDHIGSTAVSGFPDFLAKDVIDIQVTVESLDVADELAEPLLAAGYPRLEHITQDTEKTDARSTVGRYDHTDSAALWHKRVHASADPGRPTNVHLRVHGWPNQQFALLFVDWLAANPGAREDYLTVKCDADRRADGELARYVTAKEPWFLDAYQRAWEWADAVHWRP

SEQ ID NO: 205 - protein, 394 aa, Mycobacterium tuberculosis
MTLDVPVNQGHVPPGSVACCLVGVTAVADGIAGHSLSNFGALPPEINSGRMYSGPGSGPLMAAAAAWDGLAAELSSAATGYGAAISELTNMRWWSGPASDSMVAAVLPFVGWLSTTATLAEQAAMQARAAAAAFEAAFAMTVPPPAIAANRTLLMTLVDTNWFGQNTPAIATTESQYAEMWAQDAAAMYGYASAAAPATVLTPFAPPPQTTNATGLVGHATAVAALRGQHSWAAAIPWSDIQKYWMMFLGALATAEGFIYDSGGLTLNALQFVGGMLWSTALAEAGAAEAAAGAGGAAGWSAWSQLGAGPVAASATLAAKIGPMSVPPGWSAPPATPQAQTVARSIPGIRSAAEAAETSVLLRGAPTPGRSRAAHMGRRYGRRLTVMADRPNVG

SEQ ID NO: 206 - protein, 203 aa, Mycobacterium tuberculosis [sequence omitted]

SEQ ID NO: 207 - protein, 655 aa, Mycobacterium tuberculosis
MLPNFAVLPPEVNSARVFAGAGSAPMLAAAAAWDDLASELHCAAMSFGSVTSGLVVGWWQGSASAAMVDAAASYIGWLSTSAAHAEGAAGLARAAVSVFEEALAATVHPAMVAANRAQVASLVASNLFGQNAPAIAALESLYECMWAQDAAAMAGYYVGASAVATQLASWLQRLQSIPGAASLDARLPSSAEAPMGVVRAVNSAIAANAAAAQTVGLVMGGSGTPIPSARYVELANALYMSGSVPGVIAQALFTPQGLYPVVVIKNLTFDSSVAQGAVILESAIRQQIAAGNNVTVFGYSQSATISSLVMANLAASADPPSPDELSFTLIGNPNNPNGGVATRFPGISFPSLGVTATGATPHNLYPTKIYTIEYDGVADFPRYPLNFVSTLNAIAGTYYVHSNYFILTPEQIDAAVPLTNTVGPTMTQYYIIRTENLPLLEPLRSVPIVGNPLANLVQPNLKVIVNLGYGDPAYGYSTSPPNVATPFGLFPEVSPVVIADALVAGTQQGIGDFAYDVSHLELPLPADGSTMPSTAPGSGTPVPPLSIDSLIDDLQVANRNLANTISKVAATSYATVLPTADIANAALTIVPSYNIHLFLEGIQQALKGDPMGLVNAVGYPLAADVALFTAAGGLQLLIIISAGRTIANDISAIVP

SEQ ID NO: 208 - protein, 485 aa, Mycobacterium tuberculosis
MSSSESPAGIAQIGVTGLAVMGSNIARNFARHGYTVAVHNRSVAKTDALLKEHSSDGKFVRSETIPEFLAALEKPRRVLIMVKAGEATDADAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 209 - protein, 462 aa, Mycobacterium tuberculosis
VAQAPHIHRTRYAKCGDMDIAYQVLGDGPTDLLVLPGPFVPIDSIDDEPSLYRFHRRLASFSRVIRLDHRGVGLSSRLAAITTLGPKFWAQDAIAVMDAVGCEQATIFAPSFHAMNGLVLAADYPERVRSLIVVNGSARPLWAPDYPVGAQVRRADPFLTVALEPDAVERGFDVLSIVAPTVAGDDVFRAWWDLAGNRAGPPSIARAVSKVIAEADVRDVLGHIEAPTLILHRVGSTYIPVGHGRYLAEHIAGSRLVELPGTDTLYWVGDTGPMLDEIEEFITGVRGGADAERMLATIMFTDIVGSTQHAAALGDDRWRDLLDNHDTIVCHEIQRFGGREVNTAGDGFVATFTSPSAAIACADDIVDAVAALGIEVRIGIHAGEVEVRDASHGTDVAGVAVHIGARVCALAGPSEVLVSSTVRDIVAGSRHRFAERGEQELKGVPGRWRLCVLMRDDATRTR

SEQ ID NO: 210 - protein, 342 aa, Mycobacterium tuberculosis
MRENLGGVVVRLGVFLAVCLLTAFLLIAVFGEVRFGDGKTYYAEFANVSNLRTGKLVRIAGVEVGKVTRISINPDATVRVQFTADNSVTLTRGTRAVIRYDNLFGDRYLALEEGAGGLAVLRPGHTIPLARTQPALDLDALIGGFKPLFRALNPEQVNALSEQLLHAFAGQGPTIGSLLAQSAAVTNTLADRDRLIGQVITNLNVVLGSLGAHTDRLDQAVTSLSALIHRLAQRKTDISNAVAYTNAAAGSVADLLSQARAPLAKVVRETDRVAGIAAADHDYLDNLLNTLPDKYQALVRQGMYGDFFAFYLCDVVLKVNGKGGQPVYIKLAGQDSGRCAPK

SEQ ID NO: 211 - protein, 221 aa, Mycobacterium tuberculosis
MSRRASATCALSATTAVAIMAAPAARADDKRLNDGVVANVYTVQRQAGCTNDVTINPQLQLAAQWHTLDLLNNRHLNDDTGSDGSTPQDRAHAAGFRGKVAETVAINPAVAISGIELINQWYYNPAFFAIMSDCANTQIGVWSENSPDRTVVVAVYGQPDRPSAMPPRGAVTGPPSPVAAQENVPIDPSPDYDASDEIEYGINWLPWILRGVYPPPAMPPQ

SEQ ID NO: 212 - protein, 322 aa, Mycobacterium tuberculosis
MTGKLVERVHAINWNRLLDAKDLQVWERLTGNFWLPEKIPLSNDLASWQTLSSTEQQTTIRVFTGLTLLDTAQATVGAVAMIDDAVTPHEEAVLTNMAFMESVHAKSYSSIFSTLCSTKQIDDAFDWSEQNPYLQRKAQIIVDYYRGDDALKRKASSVMLESFLFYSGFYLPMYWSSRGKLTNTADLIRLIIRDEAVHGYYIGYKCQRGLADLTDAERADHREYTCELLHTLYANEIDYAHDLYDELGWTDDVLPYMRYNANKALANLGYQPAFDRDTCQVNPAVRAALDPGAGENHDFFSGSGSSYVMGTHQPTTDTDWDF

SEQ ID NO: 213 - protein, 906 aa, Mycobacterium tuberculosis
VTELAELDRFTAELPFSLDDFQQRACSALERGHGVLVCAPTGAGKTVVGEFAVHLALAAGSKCFYTTPLKALSNQKHTDLTARYGRDQIGLLTGDLSVNGNAPVVVMTTEVLRNMLYADSPALQGLSYVVMDEVHFLADRMRGPVWEEVILQLPDDVRVVSLSATVSNAEEFGGWIQTVRGDTTVVVDEHRPVPLWQHVLVGKRMFDLFDYRIGEAEGQPQVNRELLRHIAHRREADRMADWQPRRRGSGRPGFYRPPGRPEVIAKLDAEGLLPAITFVFSRAGCDAAVTQCLRSPLRLTSEEERARIAEVIDHRCGDLADSDLAVLGYYEWREGLLRGLAAHHAGMLPAFRHTVEELFTAGLVKAVFATETLALGINMPARTVVLERLVKFNGEQHMPLTPGEYTQLTGRAGRRGIDVEGHAVVIWHPEIEPSEVAGLASTRTFPLRSSFAPSYNMTINLVHRMGPQQAHRLLEQSFAQYQADRSVVGLVRGIERGNRILGEIAAELGGSDAPILEYARLRARVSELERAQARASRLQRRQAATDALAALRRGDIITITHGRRGGLAVVLESARDRDDPRPLVLTEHRWAGRISSADYSGTTPVGSMTLPKRVEHRQPRVRRDLASALRSAAAGLVIPAARRVSEAGGFHDPELESSREQLRRHPVHTSPGLEDQIRQAERYLRIERDNAQLERKVAAATNSLARTFDRFVGLLTEREFIDGPATDPVVTDDGRLLARIYSESDLLVAECLRTGAWEGLKPAELAGVVSAVVYETRGGDGQGAPFGADVPTPRLRQALTQTSRLSTTLRADEQAHRITPSREPDDGFVRVIYRWSRTGDLAAALAAADVNGSGSPLLAGDFVRWCRQVLDLLDQVRNAAPNPELRATAKRAIGDIRRGVVAVDAG

SEQ ID NO: 214 - protein, 1013 aa, Mycobacterium tuberculosis
MLVLHGFWSNSGGMRLWAEDSDLLVKSPSQALRSARPHPFAAPADLIAGIHPGKPATAVLLLPSLRSAPLDSPELIRLAPRPAARTDPMLLAWTVPVVDLDPTAALAAFDQPAPDVRYGASVDYLAELAVFARELVERGRVLPQLRRDTHGAAACWRPVLQGRDVVAMTSLVSAMPPVCRAEVGGHDPHELATSALDAMVDAAVRAALSPMDLLPPRRGRSKRHRAVEAWLTALTCPDGRFDAEPDELDALAEALRPWDDVGIGTVGPARATFRLSEVETENEETPAGSLWRLEFLLQSTQDPSLLVPAEQAWNDDGSLRRWLDRPQELLLTELGRASRIFPELVPALRTACPSGLELDADGAYRFLSGTAAVLDEAGFGVLLPSWWDRRRKLGLVLSAYTPVDGVVGKASKFGREQLVEFRWELAVGDDPLSEEEIAALTETKSPLIRLRGQWVALDTEQMRRGLEFLERKPTGRKTTAEILALAASHPDDVDTPLEVTAVRADGWLGDLLAGAAAASLQPLDPPDGFTATLRPYQQRGLAWLAFLSSLGLGSCLADDMGLGKTVQLLALETLESVQRHQDRGVGPTLLLCPMSLVGNWPQEAARFAPNLRVYAHHGGARLHGEALRDHLERTDLVVSTYTTATRDIDELAEYEWNRVVLDEAQAVKNSLSRAAKAVRRLRAAHRVALTGTPMENRLAELWSIMDFLNPGLLGSSERFRTRYAIPIERHGHTEPAERLRASTRPYILRRLKTDPAIIDDLPEKIEIKQYCQLTTEQASLYQAVVADMMEKIENTEGIERRGNVLAAMAKLKQVCNHPAQLLHDRSPVGRRSGKVIRLEEILEEILAEGDRVLCFTQFTEFAELLVPHLAARFGRAARDIAYLHGGTPRKRRDEMVARFQSGDGPPIFLLSLKAGGTGLNLTAANHVVHLDRWWNPAVENQATDRAFRIGQRRTVQVRKFICTGTLEEKIDEMIEEKKALADLVVTDGEGWLTELSTRDLREVFALSEGAVGE

SEQ ID NO: 215 - protein, 291 aa, Mycobacterium tuberculosis
VTWPLPDRLSINSLSGTPAVDLSSFTDFLRRQAPELLPASISGGAPLAGGDAQLPHGTTIVALKYPGGVVMAGDRRSTQGNMISGRDVRKVYITDDYTATGIAGTAAVAVEFARLYAVELEHYEKLEGVPLTFAGKINRLAIMVRGNLAAAMQGLLALPLLAGYDIHASDPQSAGRIVSFDAAGGWNIEEEGYQAVGSGSLFAKSSMKKLYSQVTDGDSGLRVAVEALYDAADDDSATGGPDLVRGIFPTAVIIDADGAVDVPESRIAELARAIIESRSGADTFGSDGGEK

SEQ ID NO: 216 - protein, 280 aa, Mycobacterium tuberculosis
VSATGPFSIGERVQLTDAKGRRYTMSLTPGAEFHTHRGSIAHDAVIGLEQGSVVKSSNGALFLVLRPLLVDYVMSMPRGPQVIYPKDAAQIVHEGDIFPGARVLEAGAGSGALTLSLLRAVGPAGQVISYEQRADHAEHARRNVSGCYGQPPDNWRLVVSDLADSELPDGSVDRAVLDMLAPWEVLDAVSRLLVAGGVLMVYVATVTQLSRIVEALRAKQCWTEPRAWETLQRGWNVVGLAVRPQHSMRGHTAFLVATRRLAPGAVAPAPLGRKREGRDG

SEQ ID NO: 217 - protein, 118 aa, Mycobacterium tuberculosis
MLIIALVLALIGLLALVFAVVTSNQLVAWVCIGASVLGVALLIVDALRERQQGGADEADGAGETGVAEEADVDYPEEAPEESQAVDAGVIGSEEPSEEASEATEESAVSADRSDDSAK

SEQ ID NO: 218 - protein, 96 aa, Mycobacterium tuberculosis
LVVFFQILGFALFIFWLLLIARVVVEFIRSFSRDWRPTGVTVVILEIIMSITDPPVKVLRRLIPQLTIGAVRFDLSIMVLLLVAFIGMQLAFGAAA

SEQ ID NO: 219 - protein, 241 aa, Mycobacterium tuberculosis
VNSHCSHTFITDNRSPRARRGHAMSTLHKVKAYFGMAPMEDYDDEYYDDRAPSRGYARPRFDDDYGRYDGRDYDDARSDSRGDLRGEPADYPPPGYRGGYADEPRFRPREFDRAEMTRPRFGSWLRNSTRGALAMDPRRMAMMFEDGHPLSKITTLRPKDYSEARTIGERFRDGSPVIMDLVSMDNADAKRLVDFAAGLAFALRGSFDKVATKVFLLSPADVDVSPEERRRIAETGFYAYQ

SEQ ID NO: 220 - protein, 258 aa, Mycobacterium tuberculosis
MAADLSAYPDRESELTHALAAMRSRLAAAAEAAGRNVGEIELLPITKFFPATDVAILFRLGCRSVGESREQEASAKMAELNRLLAAAELGHSGGVHWHMVGRIQRNKAGSLARWAHTAHSVDSSRLVTALDRAVVAALAEHRRGERLRVYVQVSLDGDGSRGGVDSTTPGAVDRICAQVQESEGLELVGLMGIPPLDWDPDEAFDRLQSEHNRVRAMFPHAIGLSAGMSNDLEVAVKHGSTCVRVGTALLGPRRLRSP

SEQ ID NO: 221 - protein, 379 aa, Mycobacterium tuberculosis
MTPPHNYLAVIKVVGIGGGGVNAVNRMIEQGLKGVEFIAINTDAQALLMSDADVKLDVGRDSTRGLGAGADPEVGRKAAEDAKDEIEELLRGADMVFVTAGEGGGTGTGGAPVVASIARKLGALTVGVVTRPFSFEGKRRSNQAENGIAALRESCDTLIVIPNDRLLQMGDAAVSLMDAFRSADEVLLNGVQGITDLITTPGLINVDFADVKGIMSGAGTALMGIGSARGEGRSLKAAEIAINSPLLEASMEGAQGVLMSIAGGSDLGLFEINEAASLVQDAAHPDANIIFGTVIDDSLGDEVRVTVIAAGFDVSGPGRKPVMGETGGAHRIESAKAGKLTSTLFEPVDAVSVPLHTNGATLSIGGDDDDVDVPPFMRR

SEQ ID NO: 222 - protein, 494 aa, Mycobacterium tuberculosis
VSTEQLPPDLRRVHMVGIGGAGMSGIARILLDRGGLVSGSDAKESRGVHALRARGALIRIGHDASSLDLLPGGATAVVTTHAAIPKTNPELVEARRRGIPVVLRPAVLAKLMAGRTTLMVTGTHGKTTTTSMLIVALQHCGLDPSFAVGGELGEAGTNAHHGSGDCFVAEADESDGSLLQYTPHVAVITNIESDHLDFYGSVEAYVAVFDSFVERIVPGGALVVCTDDPGGAALAQRATELGIRVLRYGSVPGETMAATLVSWQQQGVGAVAHIRLASELATAQGPRVMRLSVPGRHMALNALGALLAAVQIGAPADEVLDGLAGFEGVRRRFELVGTCGVGKASVRVFDDYAHHPTEISATLAAARMVLEQGDGGRCMVVFQPHLYSRTKAFAAEFGRALNAADEVFVLDVYGAREQPLAGVSGASVAEHVTVPMRYVPDFSAVAQQVAAAASPGDVIVTMGAGDVTLLGPEILTALRVRANRSAPGRPGVLG

SEQ ID NO: 223 - protein, 410 aa, Mycobacterium tuberculosis
VKDTVSQPAGGRGATAPRPADAASPSCGSSPSADSVSVVLAGGGTAGHVEPAMAVADALVALDPRVRITALGTLRGLETRLVPQRGYHLELITAVPMPRKPGGDLARLPSRVWRAVREARDVLDDVDADVVVGFGGYVALPAYLAARGLPLPPRRRRRIPVVIHEANARAGLANRVGAHTADRVLSAVPDSGLRRAEVVGVPVRASIAALDRAVLRAEARAHFGFPDDARVLLVFGGSQGAVSLNRAVSGAAADLAAAGVCVLHAHGPQNVLELRRRAQGDPPYVAVPYLDRMELAYAAADLVICRAGAMTVAEVSAVGLPAIYVPLPIGNGEQRLNALPVVNAGGGMVVADAALTPELVARQVAGLLTDPARLAAMTAAAARVGHRDAAGQVARAALAVATGAGARTTT

SEQ ID NO: 224 - protein, 524 aa, Mycobacterium tuberculosis
VLTRLLRRGTSDTDGSQTRGAEPVEGQRTGPEEASNPGSARPRTRFGAWLGRPMTSFHLIIAVAALLTTLGLIMVLSASAVRSYDDDGSAWVIFGKQVLWTLVGLIGGYVCLRMSVRFMRRIAFSGFAITIVMLVLVLVPGIGKEANGSRGWFVVAGFSMQPSELAKMAFAIWGAHLLAARRMERASLREMLIPLVPAAVVALALIVAQPDLGQTVSMGIILLGLLWYAGLPLRVFLSSLAAVVVSAAILAVSAGYRSDRVRSWLNPENDPQDSGYQARQAKFALAQGGIFGDGLGQGVAKWNYLPNAHNDFIFAIIGEELGLVGALGLLGLFGLFAYTGMRIASRSADPFLRLLTATTTLWVLGQAFINIGYVIGLLPVTGLQLPLISAGGTSTAATLSLIGIIANAARHEPEAVAALRAGRDDKVNRLLRLPLPEPYLPPRLEAFRDRKRANPQPAQTQPARKTPRTAPGQPARQMGLPPRPGSPRTADPPVRRSVHHGAGQRYAGQRRTRRVRALEGQRYG

SEQ ID NO: 225 - protein, 486 aa, Mycobacterium tuberculosis
VLDPLGPGAPVLVAGGRVTGQAVAAVLTRFGATPTVCDDDPVMLRPHAERGLPTVSSSDAVQQITGYALVVASPGFSPATPLLAAAAAAGVPIWGDVELAWRLDAAGCYGPPRSWLVVTGTNGKTTTTSMLHAMLIAGGRRAVLCGNIGSAVLDVLDEPAELLAVELSSFQLHWAPSLRPEAGAVLNIAEDHLDWHATMAEYTAAKARVLTGGVAVAGLDDSRAAALLDGSPAQVRVGFRLGEPAARELGVRDAHLVDRAFSDDLTLLPVASIPVPGPVGVLDALAAAALARSVGVPAGAIADAVTSFRVGRHRAEVVAVADGITYVDDSKATNPHAARASVLAYPRVVWIAGGLLKGASLHAEVAAMASRLVGAVLIGRDRAAVAEALSRHAPDVPVVQVVAGEDTGMPATVEVPVACVLDVAKDDKAGETVGAAVMTAAVAAARRMAQPGDTVLLAPAGASFDQFTGYADRGEAFATAVRAVIR

SEQ ID NO: 226 - protein, 359 aa, Mycobacterium tuberculosis
MRQILIAVAVAVTVSILLTPVLIRLFTKQGFGHQIREDGPPSHHTKRGTPSMGGVAILAGIWAGYLGAHLAGLAFDGEGIGASGLLVLGLATALGGVGFIDDLIKIRRSRNLGLNKTAKTVGQITSAVLFGVLVLQFRNAAGLTPGSADLSYVREIATVTLAPVLFVLFCVVIVSAWSNAVNFTDGLDGLAAGTMAMVTAAYVLITFWQYRNACVTAPGLGCYNVRDPLDLALIAAATAGACIGFLWWNAAPAKIFMGDTGSLALGGVIAGLSVTSRTEILAVVLGALFVAEITSVVLQILTFRTTGRRMFRMAPFHHHFELVGWAETTVIIRFWLLTAITCGLGVALFYGEWLAAVGA

SEQ ID NO: 227 - protein, 510 aa, Mycobacterium tuberculosis
MIELTVAQIAEIVGGAVADISPQDAAHRRVTGTVEFDSRAIGPGGLFLALPGARADGHDHAASAVAAGAAVVLAARPVGVPAIVVPPVAAPNVLAGVLEHDNDGSGAAVLAALAKLATAVAAQLVAGGLTIIGITGSSGKTSTKDLMAAVLAPLGEVVAPPGSFNNELGHPWTVLRATRRTDYLILEMAARHHGNIAALAEIAPPSIGVVLNVGTAHLGEFGSREVIAQTKAELPQAVPHSGAVVLNADDPAVAAMAKLTAARVVRVSRDNTGDVWAGPVSLDELARPRFTLHAHDAQAEVRLGVCGDHQVTNALCAAAVALECGASVEQVAAALTAAPPVSRHRMQVTTRGDGVTVIDDAYNANPDSMRAGLQALAWIAHQPEATRRSWAVLGEMAELGEDAIAEHDRIGRLAVRLDVSRLVVVGTGRSISAMHHGAVLEGAWGSGEATADHGADRTAVNVADGDAALALLRAELRPGDVVLVKASNAAGLGAVADALVADDTCGSVRP

SEQ ID NO: 228 - protein, 535 aa, Mycobacterium tuberculosis
VSSLARGISRRRTEVATQVEAAPTGLRPNAVVGVRLAALADQVGAALAEGPAQRAVTEDRTVTGVTLRAQDVSPGDLFAALTGSTTHGARHVGDAIARGAVAVLTDPAGVAEIAGRAAVPVLVHPAPRGVLGGLAATVYGHPSERLTVIGITGTSGKTTTTYLVEAGLRAAGRVAGLIGTIGIRVGGADLPSALTTPEAPTLQAMLAAMVERGVDTVVMEVSSHALALGRVDGTRFAVGAFTNLSRDHLDFHPSMADYFEAKASLFDPDSALRARTAVVCIDDDAGRAMAARAADAITVSAADRPAHWRATDVAPTDAGGQQFTAIDPAGVGHHIGIRLPGRYNVANCLVALAILDTVGVSPEQAVPGLREIRVPGRLEQIDRGQGFLALVDYAHKPEALRSVLTTLAHPDRRLAVVFGAGGDRDPGKRAPMGRIAAQLADLVVVTDDNPRDEDPTAIRREILAGAAEVGGDAQVVEIADRRDAIRHAVAWARPGDVVLIAGKGHETGQRGGGRVRPFDDRVELAAALEALERRA

SEQ ID NO: 229 - protein, 344 aa, Mycobacterium tuberculosis
MKFVNHIEPVAPRRAGGAVAEVYAEARREFGRLPEPLAMLSPDEGLLTAGWATLRETLLVGQVPRGRKEAVAAAVAASLRCPWCVDAHTTMLYAAGQTDTAAAILAGTAPAAGDPNAPYVAWAAGTGTPAGPPAPFGPDVAAEYLGTAVQFHFIARLVLVLLDETFLPGGPRAQQLMRRAGGLVFARKVRAEHRPGRSTRRLEPRTLPDDLAWATPSEPIATAFAALSHHLDTAPHLPPPTRQVVRRVVGSWHGEPMPMSSRWTNEHTAELPADLHAPTRLALLTGLAPHQVTDDDVAAARSLLDTDAALVGALAWAAFTAARRIGTWIGAAAEGQVSRQNPTG

SEQ ID NO: 230 - protein, 679 aa, Mycobacterium tuberculosis
VSRAAPRRASQSQSTRPARGLRRPPGAQEVGQRKRPGKTQKARQAQEATKSRPATRSDVAPAGRSTRARRTRQVVDVGTRGASFVFRHRTGNAVILVLMLVAATQLFFLQVSHAAGLRAQAAGQLKVTDVQPAARGSIVDRNNDRLAFTIEARALTFQPKRIRRQLEEARKKTSAAPDPQQRLRDIAQEVAGKLNNKPDAAAVLKKLQSDETFVYLARAVDPAVASAICAKYPEVGAERQDLRQYPGGSLAANVVGGIDWDGHGLLGLEDSLDAVLAGTDGSVTYDRGSDGVVIPGSYRNRHKAVHGSTVVLTLDNDIQFYVQQQVQQAKNLSGAHNVSAVVLDAKTGEVLAMANDNTFDPSQDIGRQGDKQLGNPAVSSPFEPGSVNKIVAASAVIEHGLSSPDEVLQVPGSIQMGGVTVHDAWEHGVMPYTTTGVFGKSSNVGTLMLSQRVGPERYYDMLRKFGLGQRTGVGLPGESAGLVPPIDQWSGSTFANLPIGQGLSMTLLQMTGMYQAIANDGVRVPPRIIKATVAPDGSRTEEPRPDDIRVVSAQTAQTVRQMLRAVVQRDPMGYQQGTGPTAGVPGYQMAGKTGTAQQINPGCGCYFDDVYWITFAGIATADNPRYVIGIMLDNPARNSDGAPGHSAAPLFHNIAGWLMQRENVPLSPDPGPPLVLQAT

SEQ ID NO: 231 - protein, 396 aa, Mycobacterium tuberculosis
VQTRAPWSLPEATLAYFPNARFVSSDRDLGAGAAPGIAASRSTACQTWGGITVADPGSGPTGFGHVPVLAQRCFELLTPALTRYYPDGSQAVLLDATIGAGGHAERFLEGLPGLRLIGLDRDPTALDVARSRLVRFADRLTLVHTRYDCLGAALAESGYAAVGSVDGILFDLGVSSMQLDRAERGFAYATDAPLDMRMDPTTPLTAADIVNTYDEAALADILRRYGEERFARRIAAGIVRRRAKTPFTSTAELVALLYQAIPAPARRVGGHPAKRTFQALRIAVNDELESLRTAVPAALDALAIGGRIAVLAYQSLEDRIVKRVFAEAVASATPAGLPVELPGHEPRFRSLTHGAERASVAEIERNPRSTPVRLRALQRVEHRAQSQQWATEKGDS

SEQ ID NO: 232 - protein, 143 aa, Mycobacterium tuberculosis
MFLGTYTPKLDDKGRLTLPAKFRDALAGGLMVTKSQDHSLAVYPRAAFEQLARRASKAPRSNPEARAFLRNLAAGTDEQHPDSQGRITLSADHRRYASLSKDCVVIGAVDYLEIWDAQAWQNYQQIHEENFSAASDEALGDIF

SEQ ID NO: 233 - protein, 214 aa, Mycobacterium tuberculosis
MVSRYSAYRRGPDVISPDVIDRILVGACAAVWLVFTGVSVAAAVALMDLGRGFHEMAGNPHTTWVLYAVIVVSALVIVGAIPVLLRARRMAEAEPATRPTGASVRGGRSIGSGHPAKRAVAESAPVQHADAFEVAAEWSSEAVDRIWLRGTVVLTSAIGIALIAVAAATYLMAVGHDGPSWISYGLAGVVTAGMPVIEWLYARQLRRVVAPQSS

SEQ ID NO: 234 - protein, 299 aa, Mycobacterium tuberculosis
MSGPNPPGREPDEPESEPVSDTGDERASGNHLPPVAGGGDKLPSDQTGETDAYSRAYSAPESEHVTGGPYVPADLRLYDYDDYEESSDLDDELAAPRWPWVVGVAAIIAAVALVVSVSLLVTRPHTSKLATGDTTSSAPPVQDEITTTKPAPPPPPPAPPPTTEIPTATETQTVTVTPPPPPPPATTTAPPPATTTTAAAPPPTTTTPTGPRQVTYSVTGTKAPGDIISVTYVDAAGRRRTQHNVYIPWSMTVTPISQSDVGSVEASSLFRVSKLNCSITTSDGTVLSSNSNDGPQTSC

SEQ ID NO: 235 - protein, 139 aa, Mycobacterium tuberculosis
MHIEARLFEFVAAFFVVTAVLYGVLTSMFATGGVEWAGTTALALTGGMALIVATFFRFVARRLDSRPEDYEGAEISDGAGELGFFSPHSWWPIMVALSGSVAAVGIALWLPWLIAAGVAFILASAAGLVFEYYVGPEKH

SEQ ID NO: 236 - protein, 363 aa, Mycobacterium tuberculosis
VTPRGPGRLQRLSQCRPQRGSGGPARGLRQLALAAMLGALAVTVSGCSWSEALGIGWPEGITPEAHLNRELWIGAVIASLAVGVIVWGLIFWSAVFHRKKNTDTELPRQFGYNMPLELVLTVIPFLIISVLFYFTVVVQEKMLQIAKDPEVVIDITSFQWNWKFGYQRVNFKDGTLTYDGADPERKRAMVSKPEGKDKYGEELVGPVRGLNTEDRTYLNFDKVETLGTSTEIPVLVLPSGKRIEFQMASADVIHAFWVPEFLFKRDVMPNPVANNSVNVFQIEEITKTGAFVGHCAEMCGTYHSMMNFEVRVVTPNDFKAYLQQRIDGKTNAEALRAINQPPLAVTTHPFDTRRGELAPQPVG

SEQ ID NO: 237 - protein, 415 aa, Mycobacterium tuberculosis
MTVPAPSQLDLRQEVHDAARRARVAARRLASLPTTVKDRALHAAADELLAHRDQILAANAEDLNAAREADTPAAMLDRLSLNPQRVDGIAAGLRQVAGLRDPVGEVLRGYTLPNGLQLRQQRVPLGVVGMIYEGRPNVTVDAFGLTLKSGNAALLRGSSSAAKSNEALVAVLRTALVGLELPADAVQLLSAADRATVTHLIQARGLVDVVIPRGGAGLIEAVVRDAQVPTIETGVGNCHVYVHQAADLDVAERILLNSKTRRPSVCNAAETLLVDAAIAETALPRLLAALQHAGVTVHLDPDEADLRREYLSLDIAVAVVDGVDAAIAHINEYGTGHTEAIVTTNLDAAQRFTEQIDAAAVMVNASTAFTDGEQFGFGAEIGISTQKLHARGPMGLPELTSTKWIAWGAGHTRPA

SEQ ID NO: 238 - protein, 738 aa, Mycobacterium tuberculosis
MGLLGGQSGPRVGSGPVGSIPTPVNAAICQQRGGFHGVERGYSAGDSGVLTSLGDNERTMNFYSAYQHGFVRVAACTHHTTIGDPAANAASVLDMARACHDDGAALAVFPELTLSGYSIEDVLLQDSLLDAVEDALLDLVTESADLLPVLVVGAPLRHRHRIYNTAVVIHRGAVLGVVPKSYLPTYREFYERRQMAPGDGERGTIRIGGADVAFGTDLLFAASDLPGFVLHVEICEDMFVPMPPSAEAALAGATVLANLSGSPITIGRAEDRRLLARSASARCLAAYVYAAAGEGESTTDLAWDGQTMIWENGALLAESERFPKGVRRSVADVDTELLRSERLRMGTFDDNRRHHRELTESFRRIDFALDPPAGDIGLLREVERFPFVPADPQRLQQDCYEAYNIQVSGLEQRLRALDYPKVVIGVSGGLDSTHALIVATHAMDREGRPRSDILAFALPGFATGEHTKNNAIKLARALGVTFSEIDIGDTARLMLHTIGHPYSVGEKVYDVTFENVQAGLRTDYLFRIANQRGGIVLGTGDLSELALGWSTYGVGDQMSHYNVNAGVPKTLIQHLIRWVISAGEFGEKVGEVLQSVLDTEITPELIPTGEEELQSSEAKVGPFALQDFSLFQVLRYGFRPSKIAFLAWHAWNDAERGNWPPGFPKSERPSYSLAEIRHWLQIFVQRFYSFSQFKRSALPNGPKVSHGGALSPRGDWRAPSDMSARIWLDQIDREVPKG

SEQ ID NO: 239 - protein, 376 aa, Mycobacterium tuberculosis
MRSPHRDAIRTARGLVVKVGTTALTTPSGMFDAGRLAGLAEAVERRMKAGSDVVIVSSGAIAAGIEPLGLSRRPKDLATKQAAASVGQVALVNSWSAAFARYGRTVGQVLLTAHDISMRVQHTNAQRTLDRLRALHAVAIVNENDTVATNEIRFGDNDRLSALVAHLVGADALVLLSDIDGLYDCDPRKTADATFIPEVSGPADLDGVVAGRSSHLGTGGMASKVAAALLAADAGVPVLLAPAADAATALADASVGTVFAARPARLSARRFWVRYAAEATGALTLDAGAVRAVVRQRRSLLAAGITAVSGRFCGGDVVELRAPDAAMVARGVVAYDASELATMVGRSTSELPGELRRPVVHADDLVAVSAKQAKQV

SEQ ID NO: 240 - protein, 479 aa, Mycobacterium tuberculosis
VPRFVDRVVIHTRAGSGGNGCASVHREKFKPLGGPDGGNGGRGGSIVFVVDPQVHTLLDFHFRPHLTAASGKHGMGNNRDGAAGADLEVKVPEGTVVLDENGRLLADLVGAGTRFEAAAGGRGGLGNAALASRVRKAPGFALLGEKGQSRDLTLELKTVADVGLVGFPSAGKSSLVSAISAAKPKIADYPFTTLVPNLGVVSAGEHAFTVADVPGLIPGASRGRGLGLDFLRHIERCAVLVHVVDCATAEPGRDPISDIDALETELACYTPTLQGDAALGDLAARPRAVVLNKIDVPEARELAEFVRDDIAQRGWPVFCVSTATRENLQPLIFGLSQMISDYNAARPVAVPRRPVIRPIPVDDSGFTVEPDGHGGFVVSGARPERWIDQTNFDNDEAVGYLADRLARLGVEEELLRLGARSGCAVTIGEMTFDWEPQTPAGEPVAMSGRGTDPRLDSNKRVGAAERKAARSRRREHGDG

SEQ ID NO: 241 - protein, 86 aa, Mycobacterium tuberculosis
MAHKKGASSSRNGRDSAAQRLGVKRYGGQVVKAGEILVRQRGTKFHPGVNVGRGGDDTLFAKTAGAVEFGIKRGRKTVSIVGSTTA

SEQ ID NO: 242 - protein, 104 aa, Mycobacterium tuberculosis
MMATYAIVKTGGKQYKVAVGDVVKVEKLESEQGEKVSLPVALVVDGATVTTDAKALAKVAVTGEVLGHTKGPKIRIHKFKNKTGYHKRQGHRQQLTVLKVTGIA

SEQ ID NO: 243 - protein, 876 aa, Mycobacterium tuberculosis
MLPKSWDPAAMESAIYQKWLDAGYFTADPTSTKPAYSIVLPPPNVTGSLHMGHALEHTMMDALTRRKRMQGYEVLWQPGTDHAGIATQSVVEQQLAVDGKTKEDLGRELFVDKVWDWKRESGGAIGGQMRRLGDGVDWSRDRFTMDEGLSRAVRTIFKRLYDAGLIYRAERLVNWSPVLQTAISDLEVNYRDVEGELVSFRYGSLDDSQPHIVVATTRVETMLGDTAIAVHPDDERYRHLVGTSLAHPFVDRELAIVADEHVDPEFGTGAVKVTPAHDPNDFEIGVRHQLPMPSILDTKGRIVDTGTRFDGMDRFEARVAVRQALAAQGRVVEEKRPYLHSVGHSERSGEPIEPRLSLQWWVRVESLAKAAGDAVRNGDTVIHPASMEPRWFSWVDDMHDWCISRQLWWGHRIPIWYGPDGEQVCVGPDETPPQGWEQDPDVLDTWFSSALWPFSTLGWPDKTAELEKFYPTSVLVTGYDILFFWVARMMMFGTFVGDDAAITLDGRRGPQVPFTDVFLHGLIRDESGRKMSKSKGNVIDPLDWVEMFGADALRFTLARGASPGGDLAVSEDAVRASRNFGTKLFNATRYALLNGAAPAPLPSPNELTDADRWILGRLEEVRAEVDSAFDGYEFSRACESLYHFAWDEFCDWYLELAKTQLAQGLTHTTAVLAAGLDTLLRLLHPVIPFLTEALWLALTGRESLVSADWPEPSGISVDLVAAQRINDMQKLVTEVRRFRSDQGLADRQKVPARMHGVRDSDLSNQVAAVTSLAWLTEPGPDFEPSVSLEVRLGPEMNRTVVVELDTSGTIDVAAERRRLEKELAGAQKELASTAAKLANADFLAKAPDAVIAKIRDRQRVAQQETERITTRLAALQ

SEQ ID NO: 244 - protein, 789 aa, Mycobacterium tuberculosis
VTKPAADASAVLTAEDTLVLASTATPVEMELIMGWLGQQRARHPDSKFDILKLPPRNAPPAALTALVEQLEPGFASSPQSGEDRSIVPVRVIWLPPADRSRAGKVAALLPGRDPYHPSQRQQRRILRTDPRRARVVAGESAKVSELRQQWRDTTVAEHKRDFAQFVSRRALLALARAEYRILGPQYKSPRLVKPEMLASARFRAGLDRIPGATVEDAGKMLDELSTGWSQVSVDLVSVLGRLASRGFDPEFDYDEYQVAAMRAALEAHPAVLLFSHRSYIDGVVVPVAMQDNRLPPVHMFGGINLSFGLMGPLMRRSGMIFIRRNIGNDPLYKYVLKEYVGYVVEKRFNLSWSIEGTRSRTGKMLPPKLGLMSYVADAYLDGRSDDILLQGVSICFDQLHEITEYAAYARGAEKTPEGLRWLYNFIKAQGERNFGKIYVRFPEAVSMRQYLGAPHGELTQDPAAKRLALQKMSFEVAWRILQATPVTATGLVSALLLTTRGTALTLDQLHHTLQDSLDYLERKQSPVSTSALRLRSREGVRAAADALSNGHPVTRVDSGREPVWYIAPDDEHAAAFYRNSVIHAFLETSIVELALAHAKHAEGDRVAAFWAQAMRLRDLLKFDFYFADSTAFRANIAQEMAWHQDWEDHLGVGGNEIDAMLYAKRPLMSDAMLRVFFEAYEIVADVLRDAPPDIGPEELTELALGLGRQFVAQGRVRSSEPVSTLLFATARQVAVDQELIAPAADLAERRVAFRRELRNILRDFDYVEQIARNQFVACEFKARQGRDRI

SEQ ID NO: 245 - protein, 268 aa, Mycobacterium tuberculosis
MPIPAPSPDARAVVTGASQNIGAALATELAARGHHLIVTARREDVLTELAARLADKYRVTVDVRPADLADPQERSKLADELAARPISILCANAGTATFGPIASLDLAGEKTQVQLNAVAVHDLTLAVLPGMIERKAGGILISGSAAGNSPIPYNATYAATKAFVNTFSESLRGELRGSGVHVTVLAPGPVRTELPDASEASLVEKLVPDFLWISTEHTARVSLNALERNKMRVVPGLTSKAMSVASQYAPRAIVAPIVGAFYKRLGGS

SEQ ID NO: 246 - protein, 3069 aa, Mycobacterium tuberculosis
VTIHEHDRVSADRGGDSPHTTHALVDRLMAGEPYAVAFGGQGSAWLETLEELVSATGIETELATLVGEAELLLDPVTDELIVVRPIGFEPLQWVRALAAEDPVPSDKHLTSAAVSVPGVLLTQIAATRALARQGMDLVATPPVAMAGHSQGVLAVEALKAGGARDVELFALAQLIGAAGTLVARRRGISVLGDRPPMVSVTNADPERIGRLLDEFAQDVRTVLPPVLSIRNGRRAVVITGTPEQLSRFELYCRQISEKEEADRKNKVRGGDVFSPVFEPVQVEVGFHTPRLSDGIDIVAGWAEKAGLDVALARELADAILIRKVDWVDEITRVHAAGARWILDLGPGDILTRLTAPVIRGLGIGIVPAATRGGQRNLFTVGATPEVARAWSSYAPTVVRLPDGRVKLSTKFTRLTGRSPILLAGMTPTTVDAKIVAAAANAGHWAELAGGGQVTEEIFGNRIEQMAGLLEPGRTYQFNALFLDPYLWKLQVGGKRLVQKARQSGAAIDGVVISAGIPDLDEAVELIDELGDIGISHVVFKPGTIEQIRSVIRIATEVPTKPVIMHVEGGRAGGHHSWEDLDDLLLATYSELRSRANITVCVGGGIGTPRRAAEYLSGRWAQAYGFPLMPIDGILVGTAAMATKESTTSPSVKRMLVDTQGTDQWISAGKAQGGMASSRSQLGADIHEIDNSASRCGRLLDEVAGDAEAVAERRDEIIAAMAKTAKPYFGDVADMTYLQWLRRYVELAIGEGNSTADTASVGSPWLADTWRDRFEQMLQRAEARLHPQDFGPIQTLFTDAGLLDNPQQAIAALLARYPDAETVQLHPADVPFFVTLCKTLGKPVNFVPVIDQDVRRWWRSDSLWQAHDARYDADAVCIIPGTASVAGITRMDEPVGELLDRFEQAAIDEVLGAGVEPKDVASRRLGRADVAGPLAVVLDAPDVRWAGRTVTNPVHRIADPAEWQVHDGPENPRATHSSTGARLQTHGDDVALSVPVSGTWVDIRFTLPANTVDGGTPVIATEDATSAMRTVLAIAAGVDSPEFLPAVANGTATLTVDWHPERVADHTGVTATFGEPLAPSLTNVPDALVGPCWPAVFAAIGSAVTDTGEPVVEGLLSLVHLDHAARVVGQLPTVPAQLTVTATAANATDTDMGRVVPVSVVVTGADGAVIATLEERFAILGRTGSAELADPARAGGAVSANATDTPRRRRRDVTITAPVDMRPFAVVSGDHNPIHTDRAAALLAGLESPIVHGMWLSAAAQHAVTATDGQARPPARLVGWTARFLGMVRPGDEVDFRVERVGIDQGAEIVDVAARVGSDLVMSASARLAAPKTVYAFPGQGIQHKGMGMEVRARSKAARKVWDTADKFTRDTLGFSVLHVVRDNPTSIIASGVHYHHPDGVLYLTQFTQVAMATVAAAQVAEMREQGAFVEGAIACGHSVGEYTALACVTGIYQLEALLEMVFHRGSKMHDIVPRDELGRSNYRLAAIRPSQIDLDDADVPAFVAGIAESTGEFLEIVNFNLRGSQYAIAGTVRGLEALEAEVERRRELTGGRRSFILVPGIDVPFHSRVLRVGVAEFRRSLDRVMPRDADPDLIIGRYIPNLVPRLFTLDRDFIQEIRDLVPAEPLDEILADYDTWLRERPREMARTVFIELLAWQFASPVRWIETQDLLFIEEAAGGLGVERFVEIGVKSSPTVAGLATNTLKLPEYAHSTVEVLNAERDAAVLFATDTDPEPEPEEDEPVAESPAPDVVSEAAPVAPAASSAGPRPDDLVFDAADATLALIALSAKMRIDQIEELDSIESITDGASSRRNQLLVDLGSELNLGAIDGAAESDLAGLRSQVTKLARTYKPYGPVLSDAINDQLRTVLGPSGKRPGAIAERVKKTWELGEGWAKHVTVEVALGTREGSSVRGGAMGHLHEGALADAASVDKVIDAAVASVAARQGVSVALPSAGSGGGATIDAAALSEFTDQITGREGVLASAARLVLGQLGLDDPVNALPAAPDSELIDLVTAELGADWPRLVAPVFDPKKAVVFDDRWASAREDLVKLWLTDEGDIDADWPRLAERFEGAGHVVATQATWWQGKSLAAGRQIHASLYGRIAAGAENPEPGRYGGEVAVVTGASKGSIAASVVARLLDGGATVIATTSKLDEERLAFYRTLYRDHARYGAALWLVAANMASYSDVDALVEWIGTEQTESLGPQSIHIKDAQTPTLLFPFAAPRVVGDLSEAGSRAEMEMKVLLWAVQRLIGGLSTIGAERDIASRLHVVLPGSPNRGMFGGDGAYGEAKSALDAVVSRWHAESSWAARVSLAHALIGWTRGTGLMGHNDAIVAAVEEAGVTTYSTDEMAALLLDLCDAESKVAAARSPIKADLTGGLAEANLDMAELAAKAREQMSAAAAVDEDAEAPGAIAALPSPPRGFTPAPPPQWDDLDVDPADLVVIVGGAEIGPYGSSRTRFEMEVENELSAAGVLELAWTTGLIRWEDDPQPGWYDTESGEMVDESELVQRYHDAVVQRVGIREFVDDGAIDPDHASPLLVSVFLEKDFAFVVSSEADARAFVEFDPEHTVIRPVPDSTDWQVIRKAGTEIRVPRKTKLSRVVGGQIPTGFDPTVWGISADMAGSIDRLAVWNMVATVDAFLSSGFSPAEVMRYVHPSLVANTQGTGMGGGTSMQTMYHGNLLGRNKPNDIFQEVLPNIIAAHVVQSYVGSYGAMIHPVAACATAAVSVEEGVDKIRLGKAQLVVAGGLDDLTLEGIIGFGDMAATADTSMMCGRGIHDSKFSRPNDRRRLGFVEAQGGGTILLARGDLALRMGLPVLAVVAFAQSFGDGVHTSIPAPGLGALGAGRGGKDSPLARALAKLGVAADDVAVISKHDTSTLANDPNETELHERLADALGRSEGAPLFVVSQKSLTGHAKGGAAVFQMMGLCQILRDGVIPPNRSLDCVDDELAGSAHFVWVRDTLRLGGKFPLKAGMLTSLGFGHVSGLVALVHPQAFIASLDPAQRADYQRRADARLLAGQRRLASAIAGGAPMYQRPGDRRFDHHAPERPQEASMLLNPAARLGDGEAYIG

SEQ ID NO: 247 - protein, 904 aa, Mycobacterium tuberculosis
VQTHEIRKRFLDHFVKAGHTEVPSASVILDDPNLLFVNAGMVQFVPFFLGQRTPPYPTATSIQKCIRTPDIDEVGITTRHNTFFQMAGNFSFGDYFKRGAIELAWALLTNSLAAGGYGLDPERIWTTVYFDDDEAVRLWQEVAGLPAERIQRRGMADNYWSMGIPGPCGPSSEIYYDRGPEFGPAGGPIVSEDRYLEVWNLVFMQNERGEGTTKEDYQILGPLPRKNIDTGMGVERIALVLQDVHNVYETDLLRPVIDTVARVAARAYDVGNHEDDVRYRIIADHSRTAAILIGDGVSPGNDGRGYVLRRLLRRVIRSAKLLGIDAAIVGDLMATVRNAMGPSYPELVADFERISRIAVAEETAFNRTLASGSRLFEEVASSTKKSGATVLSGSDAFTLHDTYGFPIELTLEMAAETGLQVDEIGFRELMAEQRRRAKADAAARKHAHADLSAYRELVDAGATEFTGFDELRSQARILGIFVDGKRVPVVAHGVAGGAGEGQRVELVLDRTPLYAESGGQIADEGTISGTGSSEAARAAVTDVQKIAKTLWVHRVNVESGEFVEGDTVIAAVDPGWRRGATQGHSGTHMVHAALRQVLGPNAVQAGSLNRPGYLRFDFNWQGPLTDDQRTQVEEVTNEAVQADFEVRTFTEQLDKAKAMGAIALFGESYPDEVRVVEMGGPFSLELCGGTHVSNTAQIGPVTILGESSIGSGVRRVEAYVGLDSFRHLAKERALMAGLASSLKVPSEEVPARVANLVERLRAAEKELERVRMASARAAATNAAAGAQRIGNVRLVAQRMSGGMTAADLRSLIGDIRGKLGSEPAVVALIAEGESQTVPYAVAANPAAQDLGIRANDLVKQLAVAVEGRGGGKADLAQGSGKNPTGIDAALDAVRSEIAVIARVG

SEQ ID NO: 248 - protein, 423 aa, Mycobacterium tuberculosis
VTEFSSFSAPKGVPDYVPPDSAQFVAVRDGLLAAARQAGYSHIELPIFEDTALFARGVGESTDVVSKEMYTFADRGDRSVTLRPEGTAGVVRAVIEHGLDRGALPVKLCYAGPFFRYERPQAGRYRQLQQVGVEAIGVDDPALDAEVIAIADAGFRSLGLDGFRLEITSLGDESCRPQYRELLQEFLFGLDLDEDTRRRAGINPLRVLDDKRPELRAMTASAPVLLDHLSDVAKQHFDTVLAHLDALGVPYVINPRMVRGLDYYTKTAFEFVHDGLGAQSGIGGGGRYDGLMHQLGGQDLSGIGFGLGVDRTVLALRAEGKTAGDSARCDVFGVPLGEAAKLRLAVLAGRLRAAGVRVDLAYGDRGLKGAMRAAARSGARVALVAGDRDIEAGTVAVKDLTTGEQVSVSMDSVVAEVISRLAG

SEQ ID NO: 249 - protein, 692 aa, Mycobacterium tuberculosis
MSAPAQPAPGVDGGDPSQARIRVPAGTTAATAVGEAGLPRRGTPDAIVVVRDADGNLRDLSWVPDVDTDITPVAANTDDGRSVIRHSTAHVLAQAVQELFPQAKLGIGPPITDGFYYDFDVPEPFTPEDLAALEKRMRQIVKEGQLFDRRVYESTEQARAELANEPYKLELVDDKSGDAEIMEVGGDELTAYDNLNPRTRERVWGDLCRGPHIPTTKHIPAFKLTRSSAAYWRGDQKNASLQRIYGTAWESQEALDRHLEFIEEAQRRDHRKLGVELDLFSFPDEIGSGLAVFHPKGGIVRRELEDYSRRKHTEAGYQFVNSPHITKAQLFHTSGHLDWYADGMFPPMHIDAEYNADGSLRKPGQDYYLKPMNCPMHCLIFRARGRSYRELPLRLFEFGTVYRYEKSGVVHGLTRVRGLTMDDAHIFCTRDQMRDELRSLLRFVLDLLADYGLTDFYLELSTKDPEKFVGAEEVWEEATTVLAEVGAESGLELVPDPGGAAFYGPKISVQVKDALGRTWQMSTIQLDFNFPERFGLEYTAADGTRHRPVMIHRALFGSIERFFGILTEHYAGAFPAWLAPVQVVGIPVADEHVAYLEEVATQLKSHGVRAEVDASDDRMAKKIVHHTNHKVPFMVLAGDRDVAAGAVSFRFGDRTQINGVARDDAVAAIVAWIADRENAVPTAELVKVAGRE

SEQ ID NO: 250 - protein, 154 aa, Mycobacterium tuberculosis
VSTTLAIVRLDPGLPLPSRAHDGDAGVDLYSAEDVELAPGRRALVRTGVAVAVPFGMVGLVHPRSGLATRVGLSIVNSPGTIDAGYRGEIKVALINLDPAAPIVVHRGDRIAQLLVQRVELVELVEVSSFDEAGLASTSRGDGGHGSSGGHASL

SEQ ID NO: 251 - protein, 438 aa, Mycobacterium tuberculosis
MPRRSPADPAAALAPRRTTLPGGLRVVTEFLPAVHSASVGVWVGVGSRDEGATVAGAAHFLEHLLFKSTPTRSAVDIAQAMDAVGGELNAFTAKEHTCYYAHVLGSDLPLAVDLVADVVLNGRCAADDVEVERDVVLEEIAMRDDDPEDALADMFLAALFGDHPVGRPVIGSAQSVSVMTRAQLQSFHLRRYTPERMVVAAAGNVDHDGLVALVREHFGSRLVRGRRPVAPRKGTGRVNGSPRLTLVSRDAEQTHVSLGIRTPGRGWEHRWALSVLHTALGGGLSSRLFQEVRETRGLAYSVYSALDLFADSGALSVYAACLPERFADVMRVTADVLESVARDGITEAECGIAKGSLRGGLVLGLEDSSSRMSRLGRSELNYGKHRSIEHTLRQIEQVTVEEVNAVARHLLSRRYGAAVLGPHGSKRSLPQQLRAMVG

SEQ ID NO: 252 - protein, 752 aa, Mycobacterium tuberculosis
MSAAEIDEGVFETTATIDNGSFGTRTIRFETGRLALQAAGAVVAYLDDDNMLLSATTASKNPKEHFDFFPLTVDVEERMYAAGRIPGSFFRREGRPSTDAILTCRLIDRPLRPSFVDGLRNEIQIVVTILSLDPGDLYDVLAINAASASTQLGGLPFSGPIGGVRVALIDGTWVGFPTVDQIERAVFDMVVAGRIVEGDVAIMMVEAEATENVVELVEGGAQAPTESVVAAGLEAAKPFIAALCTAQQELADAAGKSGKPTVDFPVFPDYGEDVYYSVSSVATDELAAALTIGGKAERDQRIDEIKTQVVQRLADTYEGREKEVGAALRALTKKLVRQRILTDHFRIDGRGITDIRALSAEVAVVPRAHGSALFERGETQILGVTTLDMIKMAQQIDSLGPETSKRYMHHYNFPPFSTGETGRVGSPKRREIGHGALAERALVPVLPSVEEFPYAIRQVSEALGSNGSTSMGSVCASTLALLNAGVPLKAPVAGIAMGLVSDDIQVEGAVDGVVERRFVTLTDILGAEDAFGDMDFKVAGTKDFVTALQLDTKLDGIPSQVLAGALEQAKDARLTILEVMAEAIDRPDEMSPYAPRVTTIKVPVDKIGEVIGPKGKVINAITEETGAQISIEDDGTVFVGATDGPSAQAAIDKINAIANPQLPTVGERFLGTVVKTTDFGAFVSLLPGRDGLVHISKLGKGKRIAKVEDVVNVGDKLRVEIADIDKRGKISLILVADEDSTAAATDAATVTS

SEQ ID NO: 253 - protein, 298 aa, Mycobacterium tuberculosis
MSATGPGIVVIDKPAGMTSHDVVGRCRRIFATRRVGHAGTLDPMATGVLVIGIERATKILGLLTAAPKSYAATIRLGQTTSTEDAEGQVLQSVPAKHLTIEAIDAAMERLRGEIRQVPSSVSAIKVGGRRAYRLARQGRSVQLEARPIRIDRFELLAARRRDQLIDIDVEIDCSSGTYIRALARDLGDALGVGGHVTALRRTRVGRFELDQARSLDDLAERPALSLSLDEACLLMFARRDLTAAEASAAANGRSLPAVGIDGVYAACDADGRVIALLRDEGSRTRSVAVLRPATMHPG

SEQ ID NO: 254 - protein, 562 aa, Mycobacterium tuberculosis
VPLTVADIDRWNAQAVREVFHAASARAEVTFEASRQLAALSIFANSGGKTAEAAAHHNAGIRRDLDAHGNEALAVARAADRAADGIVKVQSELAALRHAAAAAELTIDALINRVVPIPGLRSTEAQWARTLAKQTELQAELDAIMAEANAVDEELASAVNMADGDAPIPADSGPPVGPEGLTPTQLASDANEERLREERARLQAHLERLQAEYDQLSVRAARDYHNGILDGDAVGRLAALTDELSAARGRLGELDAVDEALSRAPETYLTQLQIPEDPNQQVLAAVAVGNPDTAANVSVTVPGVGSTTRGALPGMVTEARDLRSEVIRQLNAAGKPASVATIAWMGYHPPPNPLDTGSAGDLWQTMTDGQAHAGAADLSRYLQQVRANNPSGHLTVLGHSYGSLTASLALQDLDAQSAHPVNDVVFYGSPGLELYSPAQLGLDHGHAYVMQAPHDLITNLVAPLAPLHGWGLDPYLTPGFTELSSQAGFDPGGIWRDGVYAHGDYPRSFLDAAGQPQLRMSGYNLAAIAAGLPDNTVGPPLLPPILGGGMPAAPGPALRGGR

SEQ ID NO: 255 - protein, 603 aa, Mycobacterium tuberculosis
MVTKTTLASATSGLLLLAVVAMSGCTPRPQGPGPAAEKFFAALAIGDTASAAQLSDNPNEAREALNAAWAGLQAAHLDAQVLSAKYAEDTGTVAYRFSWHLPKDRIWTYDGQLKMARDEGRWHVRWTTSGLHPKLGEHQTFALRADPPRRASVNEVGGTDVLVPGYLYHYSLDAGQAGRELFGTAHAVVGALHPFDDTLNDPQLLAEQASSSTQPLDLVTLHADDSNRVAAAIGQLPGVVITPQAELLPTDKHFAPAVLNDVKKAVVDELDGKAGWRVVSVNQNGVDVSVLHEVAPSPASSVSITLDRVVQNAAQHAVNTRGGKAMIVVIKPSTGEILAIAQNAGADADGPVATTGLYPPGSTFKMITAGAAVERDLATPETLLGCPGEIDIGHRTIPNYGGFDLGVVPMSRAFASSCNTTFAELSSRLPPRGLTQAARRYGIGLDYQVDGITTVTGSVPPTVDLAERTEDGFGQGKVLASPFGMALVAATVAAGKTPVPQLIAGRPTAVEGDATPISQKMIDALRPMMRLVVTNGTAKEIAGCGEVFGKTGEAEFPGGSHSWFAGYRGDLAFASLIVGGGSSEYAVRMTKVMFESLPPGYLA

SEQ ID NO: 256 - protein, 387 aa, Mycobacterium tuberculosis
VTVGLGMPQPPAPTLAPRRATRQLMVGNVGVGSDHPVSVQSMCTTKTHDVNSTLQQIAELTAAGCDIVRVACPRQEDADALAEIARHSQIPVVADIHFQPRYIFAAIDAGCAAVRVNPGNIKEFDGRVGEVAKAAGAAGIPIRIGVNAGSLDKRFMEKYGKATPEALVESALWEASLFEEHGFGDIKISVKHNDPVVMVAAYELLAARCDYPLHLGVTEAGPAFQGTIKSAVAFGALLSRGIGDTIRVSLSAPPVEEVKVGNQVLESLNLRPRSLEIVSCPSCGRAQVDVYTLANEVTAGLDGLDVPLRVAVMGCVVNGPGEAREADLGVASGNGKGQIFVRGEVIKTVPEAQIVETLIEEAMRLAAEMGEQDPGATPSGSPIVTVS

SEQ ID NO: 257 - protein, 404 aa, Mycobacterium tuberculosis
MMFVTGIVLFALAILISVALHECGHMWVARRTGMKVRRYFVGFGPTLWSTRRGETEYGVKAVPLGGFCDIAGMTPVEELDPDERDRAMYKQATWKRVAVLFAGPGMNLAICLVLIYAIALVWGLPNLHPPTRAVIGETGCVAQEVSQGKLEQCTGPGPAALAGIRSGDVVVKVGDTPVSSFDEMAAAVRKSHGSVPIVVERDGTAIVTYVDIESTQRWIPNGQGGELQPATVGAIGVGAARVGPVRYGVFSAMPATFAVTGDLTVEVGKALAALPTKVGALVRAIGGGQRDPQTPISVVGASIIGGDTVDHGLWVAFWFFLAQLNLILAAINLLPLLPFDGGHIAVAVFERIRNMVRSARGKVAAAPVNYLKLLPATYVVLVLVVGYMLLTVTADLVNPIRLFQ

SEQ ID NO: 258 - protein, 436 aa, Mycobacterium tuberculosis
VATGGRVVIRRRGDNEVVAHNDEVTNSTDGRADGRLRVVVLGSTGSIGTQALQVIADNPDRFEVVGLAAGGAHLDTLLRQRAQTGVTNIAVADEHAAQRVGDIPYHGSDAATRLVEQTEADVVLNALVGALGLRPTLAALKTGARLALANKESLVAGGSLVLRAARPGQIVPVDSEHSALAQCLRGGTPDEVAKLVLTASGGPFRGWSAADLEHVTPEQAGAHPTWSMGPMNTLNSASLVNKGLEVIETHLLFGIPYDRIDVVVHPQSIIHSMVTFIDGSTIAQASPPDMKLPISLALGWPRRVSGAAAACDFHTASSWEFEPLDTDVFPAVELARQAGVAGGCMTAVYNAANEEAAAAFLAGRIGFPAIVGIIADVLHAADQWAVEPATVDDVLDAQRWARERAQRAVSGMASVAIASTAKPGAAGRHASTLERS

SEQ ID NO: 259 - protein, 1289 aa, Mycobacterium tuberculosis
VGAGSRFPLVDPLPSVGARPDRLRGQPRRRTRAGGRPGSARCVPEAAAAAAGRHDTGPRRQSRRRLVAVDGADHRVQRAVIWPLVYLKSLTLKGFKSFAAPTTLRFEPGITAVVGPNGSGKSNVVDALAWVMGEQGAKTLRGGKMEDVIFAGTSSRAPLGRAEVTVSIDNSDNALPIEYTEVSITRRMFRDGASEYEINGSSCRLMDVQELLSDSGIGREMHVIVGQGKLEEILQSRPEDRRAFIEEAAGVLKHRKRKEKALRKLDTMAANLARLTDLTTELRRQLKPLGRQAEAAQRAAAIQADLRDARLRLAADDLVSRRAEREAVFQAEAAMRREHDEAAARLAVASEELAAHESAVAELSTRAESIQHTWFGLSALAERVDATVRIASERAHHLDIEPVAVSDTDPRKPEELEAEAQQVAVAEQQLLAELDAARARLDAARAELADRERRAAEADRAHLAAVREEADRREGLARLAGQVETMRARVESIDESVARLSERIEDAAMRAQQTRAEFETVQGRIGELDQGEVGLDEHHERTVAALRLADERVAELQSAERAAERQVASLRARIDALAVGLQRKDGAAWLAHNRSGAGLFGSIAQLVKVRSGYEAALAAALGPAADALAVDGLTAAGSAVSALKQADGGRAVLVLSDWPAPQAPQSASGEMLPSGAQWALDLVESPPQLVGAMIAMLSGVAVVNDLTEAMGLVEIRPELRAVTVDGDLVGAGWVSGGSDRKLSTLEVTSEIDKARSELAAAEALAAQLNAALAGALTEQSARQDAAEQALAALNESDTAISAMYEQLGRLGQEARAAEEEWNRLLQQRTEQEAVRTQTLDDVIQLETQLRKAQETQRVQVAQPIDRQAISAAADRARGVEVEARLAVRTAEERANAVRGRADSLRRAAAAEREARVRAQQARAARLHAAAVAAAVADCGRLLAGRLHRAVDGASQLRDASAAQRQQRLAAMAAVRDEVNTLSARVGELTDSLHRDELANAQAALRIEQLEQMVLEQFGMAPADLITEYGPHVALPPTELEMAEFEQARERGEQVIAPAPMPFDRVTQERRAKRAERALAELGRVNPLALEEFAALEERYNFLSTQLEDVKAARKDLLGVVADVDARILQVFNDAFVDVEREFRGVFTALFPGGEGRLRLTEPDDMLTTGIEVEARPPGKKITRLSLLSGGEKALTAVAMLVAIFRARPSPFYIMDEVEAALDDVNLRRLLSLFEQLREQSQIIIITHQKPTMEVADALYGVTMQNDGITAVISQRMRGQQVDQLVTNSS

SEQ ID NO: 260 - protein, 240 aa, Mycobacterium tuberculosis
MIRSRQPLLDALGVDLPDELLSLALTHRSYAYENGGLPTNERLEFLGDAVLGLTITDALFHRHPDRSEGDLAKLRASVVNTQALADVARRLCAEGLGVHVLLGRGEANTGGADKSSILADGMESLLGAIYLQHGMEKAREVILRLFGPLLDAAPTLGAGLDWKTSLQELTAARGLGAPSYLVTSTGPDHDKEFTAVVVVMDSEYGSGVGRSKKEAEQKAAAAAWKALEVLDNAMPGKTSA

SEQ ID NO: 261 - protein, 1827 aa, Mycobacterium tuberculosis
MTSLAERAAQLSPNARAALARELVRAGTTFPTDICEPVAVVGIGCRFPGNVTGPESFWQLLADGVDTIEQVPPDRWDADAFYDPDPSASGRMTTKWGGFVSDVDAFDADFFGITPREAVAMDPQHRMLLEVAWEALEHAGIPPDSLSGTRTGVMMGLSSWDYTIVNIERRADIDAYLSTGTPHCAAVGRIAYLLGLRGPAVAVDTACSSSLVAIHLACQSLRLRETDVALAGGVQLTLSPFTAIALSKWSALSPTGRCNSFDANADGFVRGEGCGVVVLKRLADAVRDQDRVLAVVRGSATNSDGRSNGMTAPNALAQRDVITSALKLADVTPDSVNYVETHGTGTVLGDPIEFESLAATYGLGKGQGESPCALGSVKTNIGHLEAAAGVAGFIKAVLAVQRGHIPRNLHFTRWNPAIDASATRLFVPTESAPWPAAAGPRRAAVSSFGLSGTNAHVVVEQAPDTAVAAAGGMPYVSALNVSGKTAARVASAAAVLADWMSGPGAAAPLADVAHTLNRHRARHAKFATVIARDRAEAIAGLRALAAGQPRVGVVDCDQHAGGPGRVFVYSGQGSQWASMGQQLLANEPAFAKAVAELDPIFVDQVGFSLQQTLIDGDEVVGIDRIQPVLVGMQLALTELWRSYGVIPDAVIGHSMGEVSAAVVAGALTPEQGLRVITTRSRLMARLSGQGAMALLELDADAAEALIAGYPQVTLAVHASPRQTVIAGPPEQVDTVIAAVATQNRLARRVEVDVASHHPIIDPILPELRSALADLTPQPPSIPIISTTYESAQPVADADYWSANLRNPVRFHQAVTAAGVDHNTFIEISPHPVLTHALTDTLDPDGSHTVMSTMNRELDQTLYFHAQLAAVGVAASEHTTGRLVDLPPTPWHHQRFWVTDRSAMSELAATHPLLGAHIEMPRNGDHVWQTDVGTEVCPWLADHKVFGQPIMPAAGFAEIALAAASEALGTAADAVAPNIVINQFEVEQMLPLDGHTPLTTQLIRGGDSQIRVEIYSRTRGGEFCRHATAKVEQSPRECAHAHPEAQGPATGTTVSPADFYALLRQTGQHHGPAFAALSRIVRLADGSAETEISIPDEAPRHPGYRLHPVVLDAALQSVGAAIPDGEIAGSAEASYLPVSFETIRVYRDIGRHVRCRAHLTNLDGGTGKMGRIVLINDAGHIAAEVDGIYLRRVERRAVPLPLEQKIFDAEWTESPIAAVPAPEPAAETTRGSWLVLADATVDAPGKAQAKSMADDFVQQWRSPMRRVHTADIHDESAVLAAFAETAGDPEHPPVGVVVFVGGASSRLDDELAAARDTVWSITTVVRAVVGTWHGRSPRLWLVTGGGLSVADDEPGTPAAASLKGLVRVLAFEHPDMRTTLVDLDITQDPLTALSAELRNAGSGSRHDDVIAWRGERRFVERLSRATIDVSKGHPVVRQGASYVVTGGLGGLGLVVARWLVDRGAGRVVLGGRSDPTDEQCNVLAELQTRAEIVVVRGDVASPGVAEKLIETARQSGGQLRGVVHAAAVIEDSLVFSMSRDNLERVWAPKATGALRMHEATADCELDWWLGFSSAASLLGSPGQAAYACASAWLDALVGWRRASGLPAAVINWGPWSEVGVAQALVGSVLDTISVAEGIEALDSLLAADRIRTGVARLRADRALVAFPEIRSISYFTQVVEELDSAGDLGDWGGPDALADLDPGEARRAVTERMCARIAAVMGYTDQSTVEPAVPLDKPLTELGLDSLMAVRIRNGARADFGVEPPVALILQGASLHDLTADLMRQLGLNDPDPALNNADTIRDRARQRAAARHGAAMRRRPKPEVQGG

SEQ ID NO: 262 - protein, 1616 aa, Mycobacterium tuberculosis
VISARSAEALTAQAGRLMAHVQANPGLDPIDVGCSLASRSVFEHRAVVVGASREQLIAGLAGLAAGEPGAGVAVGQPGSVGKTVVVFPGQGAQRIGMGRELYGELPVFAQAFDAVADELDRHLRLPLRDVIWGADADLLDSTEFAQPALFAVEVASFAVLRDWGVLPDFVMGHSVGELAAAHAAGVLTLADAAMLVVARGRLMQALPAGGAMVAVAASEDEVEPLLGEGVGIAAINAPESVVISGAQAAANAIADRFAAQGRRVHQLAVSHAFHSPLMEPMLEEFARVAARVQAREPQLGLVSNVTGELAGPDFGSAQYWVDHVRRPVRFADSARHLQTLGATHFIEAGPGSGLTGSIEQSLAPAEAMVVSMLGKDRPELASALGAAGQVFTTGVPVQWSAVFAGSGGRRVQLPTYAFQRRRFWETPGADGPADAAGLGLGATEHALLGAVVERPDSDEVVLTGRLSLADQPWLADHVVNGVVLFPGAGFVELVIRAGDEVGCALIEELVLAAPLVMHPGVGVQVQVVVGAADESGHRAVSVYSRGDQSQGWLLNAEGMLGVAAAETPMDLSVWPPEGAESVDISDGYAQLAERGYAYGPAFQGLVAIWRRGSELFAEVVAPGEAGVAVDRMGMHPAVLDAVLHALGLAVEKTQASTETRLPFCWRGVSLHAGGAGRVRARFASAGADAISVDVCDATGLPVLTVRSLVTRPITAEQLRAAVTAAGGASDQGPLEVVWSPISVVSGGANGSAPPAPVSWADFCAGSDGDASVVVWELESAGGQASSVVGSVYAATHTALEVLQSWLGADRAATLVVLTHGGVGLAGEDISDLAAAAVWGMARSAQAENPGRIVLIDTDAAVDASVLAGVGEPQLLVRGGTVHAPRLSPAPALLALPAAESAWRLAAGGGGTLEDLVIQPCPEVQAPLQAGQVRVAVAAVGVNFRDVVAALGMYPGQAPPLGAEGAGVVLETGPEVTDLAVGDAVMGFLGGAGPLAVVDQQLVTRVPQGWSFAQAAAVPVVFLTAWYGLADLAEIKAGESVLIHAGTGGVGMAAVQLARQWGVEVFVTASRGKWDTLRAMGFDDDHIGDSRTCEFEEKFLAVTEGRGVDVVLDSLAGEFVDASLRLLVRGGRFLEMGKTDIRDAQEIAANYPGVQYRAFDLSEAGPARMQEMLAEVRELFDTRELHRLPVTTWDVRCAPAAFRFMSQARHIGKVVLTMPSALADRLADGTVVITGATGAVGGVLARHLVGAYGVRHLVLASRRGDRAEGAAELAADLTEAGAKVQVVACDVADRAAVAGLFAQLSREYPPVRGVIHAAGVLDDAVITSLTPDRIDTVLRAKVDAAWNLHQATSDLDLSMFALCSSIAATVGSPGQGNYSAANAFLDGLAAHRQAAGLAGISLAWGLWEQPGGMTAHLSSRDLARMSRSGLAPMSPAEAVELFDAALAIDHPLAVATLLDRAALDARAQAGALPALFSGLARRPRRRQIDDTGDATSSKSALAQRLHGLAADEQLELLVGLVCLQAAAVLGRPSAEDVDPDTEFGDLGFDSLTAVELRNRLKTATGLTLPPTVIFDHPTPTAVAEYVAQQMSGSRPTESGDPTSQVVEPAAAEVSVHA

SEQ ID NO: 263 - protein, 691 aa, Mycobacterium tuberculosis
VSSPDADQTAPEVLRQWQALAEEVREHQFRYYVRDAPIISDAEFDELLRRLEALEEQHPELRTPDSPTQLVGGAGFATDFEPVDHLERMLSLDNAFTADELAAWAGRIHAEVGDAAHYLCELKIDGVALSLVYREGRLTRASTRGDGRTGEDVTLNARTIADVPERLTPGDDYPVPEVLEVRGEVFFRLDDFQALNASLVEEGKAPFANPRNSAAGSLRQKDPAVTARRRLRMICHGLGHVEGFRPATLHQAYLALRAWGLPVSEHTTLATDLAGVRERIDYWGEHRHEVDHEIDGVVVKVDEVALQRRLGSTSRAPRWAIAYKYPPEEAQTKLLDIRVNVGRTGRITPFAFMTPVKVAGSTVGQATLHNASEIKRKGVLIGDTVVIRKAGDVIPEVLGPVVELRDGSEREFIMPTTCPECGSPLAPEKEGDADIRCPNARGCPGQLRERVFHVASRNGLDIEVLGYEAGVALLQAKVIADEGELFALTERDLLRTDLFRTKAGELSANGKRLLVNLDKAKAAPLWRVLVALSIRHVGPTAARALATEFGSLDAIAAASTDQLAAVEGVGPTIAAAVTEWFAVDWHREIVDKWRAAGVRMVDERDESVPRTLAGLTIVVTGSLTGFSRDDAKEAIVARGGKAAGSVSKKTNYVVAGDSPGSKYDKAVELGVPILDEDGFRRLLADGPASRT

SEQ ID NO: 264 - protein, 393 aa, Mycobacterium tuberculosis
MAYLDHAATTPMHPAAIEAMAAVQRTIGNASSLHTSGRSARRRIEEARELIADKLGARPSEVIFTAGGTESDNLAVKGIYWARRDAEPHRRRIVTTEVEHHAVLDSVNWLVEHEGAHVTWLPTAADGSVSATALREALQSHDDVALVSVMWANNEVGTILPIAEMSVVAMEFGVPMHSDAIQAVGQLPLDFGASGLSAMSVAGHKFGGPPGVGALLLRRDVTCVPLMHGGGQERDIRSGTPDVASAVGMATAAQIAVDGLEENSARLRLLRDRLVEGVLAEIDDVCLNGADDPMRLAGNAHFTFRGCEGDALLMLLDANGIECSTGSACTAGVAQPSHVLIAMGVDAASARGSLRLSLGHTSVEADVDAALEVLPGAVARARRAALAAAGASR

SEQ ID NO: 265 - protein, 1110 aa, Mycobacterium tuberculosis
MTDVDPHATRRDLVPNIPAELLEAGFDNVEEIGRGGFGVVYRCVQPSLDRAVAVKVLSTDLDRDNLERFLREQRAMGRLSGHPHIVTVLQVGVLAGGRPFIVMPYHAKNSLETLIRRHGPLDWRETLSIGVKLAGALEAAHRVGTLHRDVKPGNILLTDYGEPQLTDFGIARIAGGFETATGVIAGSPAFTAPEVLEGASPTPASDVYSLGATLFCALTGHAAYERRSGERVIAQFLRITSQPIPDLRKQGLPADVAAAIERAMARHPADRPATAADVGEELRDVQRRNGVSVDEMPLPVELGVERRRSPEAHAAHRHTGGGTPTVPTPPTPATKYRPSVPTGSLVTRSRLTDILRAGGRRRLILIHAPSGFGKSTLAAQWREELSRDGAAVAWLTIDNDDNNEVWFLSHLLESIRRVRPTLAESLGHVLEEHGDDAGRYVLTSLIDEIHENDDRIAVVIDDWHRVSDSRTQAALGFLLDNGCHHLQLIVTSWSRAGLPVGRLRIGDELAEIDSAALRFDTDEAAALLNDAGGLRLPRADVQALTTSTDGWAAALRLAALSLRGGGDATQLLRGLSGASDVIHEFLSENVLDTLEPELREFLLVASVTERTCGGLASALAGITNGRAMLEEAEHRGLFLQRTEDDPNWFRFHQMFADFLHRRLERGGSHRVAELHRRASAWFAENGYLHEAVDHALAAGDPARAVDLVEQDETNLPEQSKMTTLLAIVQKLPTSMVVSRARLQLAIAWANILLQRPAPATGALNRFETALGRAELPEATQADLRAEADVLRAVAEVFADRVERVDDLLAEAMSRPDTLPPRVPGTAGNTAALAAICRFEFAEVYPLLDWAAPYQEMMGPFGTVYAQCLRGMAARNRLDIVAALQNFRTAFEVGTAVGAHSHAARLAGSLLAELLYETGDLAGAGRLMDESYLLGSEGGAVDYLAARYVIGARVKAAQGDHEGAADRLSTGGDTAVQLGLPRLAARINNERIRLGIALPAAVAADLLAPRTIPRDNGIATMTAELDEDSAVRLLSAGDSADRDQACQRAGALAAAIDGTRRPLAALQAQILHIETLAATGRESDARNELAPVATKCAELGLSRLLVDAGLA

SEQ ID NO: 266 - protein, 456 aa, Mycobacterium tuberculosis
MRPYYIAIVGSGPSAFFAAASLLKAADTTEDLDMAVDMLEMLPTPWGLVRSGVAPDHPKIKSISKQFEKTAEDPRFRFFGNVVVGEHVQPGELSERYDAVIYAVGAQSDRMLNIPGEDLPGSIAAVDFVGWYNAHPHFEQVSPDLSGARAVVIGNGNVALDVARILLTDPDVLARTDIADHALESLRPRGIQEVVIVGRRGPLQAAFTTLELRELADLDGVDVVIDPAELDGITDEDAAAVGKVCKQNIKVLRGYADREPRPGHRRMVFRFLTSPIEIKGKRKVERIVLGRNELVSDGSGRVAAKDTGEREELPAQLVVRSVGYRGVPTPGLPFDDQSGTIPNVGGRINGSPNEYVVGWIKRGPTGVIGTNKKDAQDTVDTLIKNLGNAKEGAECKSFPEDHADQVADWLAARQPKLVTSAHWQVIDAFERAAGEPHGRPRVKLASLAELLRIGLG

SEQ ID NO: 267 - protein, 213 aa, Mycobacterium tuberculosis
MMASNQTAAQHSSATLQQAPRSIDDAGGCPLTISPIANSPGDTFAVTPVVEYEPPPRNIPPCGQSSHAARRPHTPQLARRQPIRPSGRAPAAVTSTAKSPRLRQAGTFADAALRRVLEVIDRRRPVGQLRPLLAPGLVDSVLAVSRTAAGHQQGAAMLRRIRLTPAGPDTADTAAEVFGTYSRGDRIHAIACRVEQRPAGNETRWLMVALHIG

SEQ ID NO: 268 - protein, 408 aa, Mycobacterium tuberculosis
VELLRGALRTYAWGSRTAIAEFTGRPVPAAHPEAELWFGAHPGDPAWLQTPHGQTSLLEALVADPEGQLGSASRARFGDVLPFLVKVLAADEPLSLQAHPSAEQAVEGYLREERMGIPVSSPVRNYRDTSHKPELLVALQPFEALAGFREAARTTELLRALAVSDLDPFIDLLSEGSDADGLRALFTTWITAPQPDIDVLVPAVLDGAIQYVSSGATEFGAEAKTVLELGERYPGDAGVLAALLLNRISLAPGEAIFLPAGNLHAYVRGFGVEVMANSDNVLRGGLTPKHVDVPELLRVLDFAPTPKARLRPPIRREGLGLVFETPTDEFAATLLVLDGDHLGHEVDASSGHDGPQILLCTEGSATVHGKCGSLTLQRGTAAWVAADDGPIRLTAGQPAKLFRATVGL

SEQ ID NO: 269 - protein, 359 aa, Mycobacterium tuberculosis
LATHQVDAVVLVGGKGTRLRPLTLSAPKPMLPTAGLPFLTHLLSRIAAAGIEHVILGTSYKPAVFEAEFGDGSALGLQIEYVTEEHPLGTGGGIANVAGKLRNDTAMVFNGDVLSGADLAQLLDFHRSNRADVTLQLVRVGDPRAFGCVPTDEEDRVVAFLEKTEDPPTDQINAGCYVFERNVIDRIPQGREVSVEREVFPALLADGDCKIYGYVDASYWRDMGTPEDFVRGSADLVRGIAPSPALRGHRGEQLVHDGAAVSPGALLIGGTVVGRGAEIGPGTRLDGAVIFDGVRVEAGCVIERSIIGFGARIGPRALIRDGVIGDGADIGARCELLSGARVWPGVFLPDGGIRYSSDV

SEQ ID NO: 270 - protein, 214 aa, Mycobacterium tuberculosis
MTLNLSVDEVLTTTRSVRKRLDFDKPVPRDVLMECLELALQAPTGSNSQGWQWVFVEDAAKKKAIADVYLANARGYLSGPAPEYPDGDTRGERMGRVRDSATYLAEHMHRAPVLLIPCLKGREDESAVGGVSFWASLFPAVWSFCLALRSRGLGSCWTTLHLLDNGEHKVADVLGIPYDEYSQGGLLPIAYTQGIDFRPAKRLPAESVTHWNGW

SEQ ID NO: 271 - protein, 329 aa, Mycobacterium tuberculosis
MAEVFVGPVAQGYASGEVTVLLASPRSFCAGVERAIETVKRVLDVAEGPVYVRKQIVHNTVVVAELRDRGAVFVEDLDEIPDPPPPGAVVVFSAHGVSPAVRAGADERGLQVVDATCPLVAKVHAEAARFAARGDTVVFIGHAGHEETEGTLGVAPRSTLLVQTPADVAALNLPEGTQLSYLTQTTLALDETADVIDALRARFPTLGQPPSEDICYATTNRQRALQSMVGECDVVLVIGSCNSSNSRRLVELAQRSGTPAYLIDGPDDIEPEWLSSVSTIGVTAGASAPPRLVGQVIDALRGYASITVVERSIATETVRFGLPKQVRAQ

SEQ ID NO: 272 - protein, 100 aa, Mycobacterium tuberculosis
VAKVNIKPLEDKILVQANEAETTTASGLVIPDTAKEKPQEGTVVAVGPGRWDEDGEKRIPLDVAEGDTVIYSKYGGTEIKYNGEEYLILSARDVLAVVSK

SEQ ID NO: 273 - protein, 408 aa, Mycobacterium tuberculosis
VKRFWENVGKPNDTTDGRGTTSLAMTPISQTPGLLAEAMVDLGAIEHNVRVLREHAGHAQLMAVVKADGYGHGATRVAQTALGAGAAELGVATVDEALALRADGITAPVLAWLHPPGIDFGPALLADVQVAVSSLRQLDELLHAVRRTGRTATVTVKVDTGLNRNGVGPAQFPAMLTALRQAMAEDAVRLRGLMSHMVYADKPDDSINDVQAQRFTAFLAQAREQGVRFEVAHLSNSSATMARPDLTFDLVRPGIAVYGLSPVPALGDMGLVPAMTVKCAVALVKSIRAGEGVSYGHTWIAPRDTNLALLPIGYADGVFRSLGGRLEVLINGRRCPGVGRICMDQFMVDLGPGPLDVAEGDEAILFGPGIRGEPTAQDWADLVGTIHYEVVTSPRGRITRTYREAENR

SEQ ID NO: 274 - protein, 500 aa, Mycobacterium tuberculosis
MAPSGGQEAQICDSETFGDSDFVVVANRLPVDLERLPDGSTTWKRSPGGLVTALEPVLRRRRGAWVGWPGVNDDGAEPDLHVLDGPIIQDELELHPVRLSTTDIAQYYEGFSNATLWPLYHDVIVKPLYHREWWDRYVDVNQRFAEAASRAAAHGATVWVQDYQLQLVPKMLRMLRPDLTIGFFLHIPFPPVELFMQMPWRTEIIQGLLGADLVGFHLPGGAQNFLILSRRLVGTDTSRGTVGVRSRFGAAVLGSRTIRVGAFPISVDSGALDHAARDRNIRRRAREIRTELGNPRKILLGVDRLDYTKGIDVRLKAFSELLAEGRVKRDDTVVVQLATPSRERVESYQTLRNDIERQVGHINGEYGEVGHPVVHYLHRPAPRDELIAFFVASDVMLVTPLRDGMNLVAKEYVACRSDLGGALVLSEFTGAAAELRHAYLVNPHDLEGVKDGIEEALNQTEEAGRRRMRSLRRQVLAHDVDRWAQSFLDALAGAHPRGQG

SEQ ID NO: 275 - protein, 505 aa, Mycobacterium tuberculosis
VSAADTAEDLPEQFRIRRDKRARLLAQGRDPYPVAVPRTHTLAEVRAAHPDLPIDTATEDIVGVAGRVIFARNSGKLCFATLQDGDGTQLQVMISLDKVGQAALDAWKADVDLGDIVYVHGAVISSRRGELSVLADCWRIAAKSLRPLPVAHKEMSEESRVRQRYVDLIVRPEARAVARLRIAVVRAIRTALQRRGFLEVETPVLQTLAGGAAARPFATHSNALDIDLYLRIAPELFLKRCIVGGFDKVFELNRVFRNEGADSTHSPEFSMLETYQTYGTYDDSAVVTRELIQEVADEAIGTRQLPLPDGSVYDIDGEWATIQMYPSLSVALGEEITPQTTVDRLRGIADSLGLEKDPAIHDNRGFGHGKLIEELWERTVGKSLSAPTFVKDFPVQTTPLTRQHRSIPGVTEKWDLYLRGIELATGYSELSDPVVQRERFADQARAAAAGDDEAMVLDEDFLAALEYGMPPCTGTGMGIDRLLMSLTGLSIRETVLFPIVRPHSN

SEQ ID NO: 276 - protein, 272 aa, Mycobacterium tuberculosis
VLLAIDVRNTHTVVGLLSGMKEHAKVVQQWRIRTESEVTADELALTIDGLIGEDSERLTGTAALSTVPSVLHEVRIMLDQYWPSVPHVLIEPGVRTGIPLLVDNPKEVGADRIVNCLAAYDRFRKAAIVVDFGSSICVDVVSAKGEFLGGAIAPGVQVSSDAAAARSAALRRVELARPRSVVGKNTVECMQAGAVFGFAGLVDGLVGRIREDVSGFSVDHDVAIVATGHTAPLLLPELHTVDHYDQHLTLQGLRLVFERNLEVQRGRLKTAR

SEQ ID NO: 277 - protein, 188 aa, Mycobacterium tuberculosis
MTRVVLSVGSNLGDRLARLRSVADGLGDALIAASPIYEADPWGGVEQGQFLNAVLIADDPTCEPREWLRRAQEFERAAGRVRGQRWGPRNLDVDLIACYQTSATEALVEVTARENHLTLPHPLAHLRAFVLIPWIAVDPTAQLTVAGCPRPVTRLLAELEPADRDSVRLFRPSFDLNSRHPVSRAPES

SEQ ID NO: 278 - protein, 280 aa, Mycobacterium tuberculosis
VSPAPVQVMGVLNVTDDSFSDGGCYLDLDDAVKHGLAMAAAGAGIVDVGGESSRPGATRVDPAVETSRVIPVVKELAAQGITVSIDTMRADVARAALQNGAQMVNDVSGGRADPAMGPLLAEADVPWVLMHWRAVSADTPHVPVRYGNVVAEVRADLLASVADAVAAGVDPARLVLDPGLGFAKTAQHNWAILHALPELVATGIPVLVGASRKRFLGALLAGPDGVMRPTDGRDTATAVISALAALHGAWGVRVHDVRASVDAIKVVEAWMGAERIERDG

SEQ ID NO: 279 - protein, 202 aa, Mycobacterium tuberculosis
MSQLDSRSASARIRVFDQQRAEAAVRELLYAIGEDPDRDGLVATPSRVARSYREMFAGLYTDPDSVLNTMFDEDHDELVLVKEIPMYSTCEHHLVAFHGVAHVGYIPGDDGRVTGLSKIARLVDLYAKRPQVQERLTSQIADALMKKLDPRGVIVVIEAEHLCMAMRGVRKPGSVTTTSAVRGLFKTNAASRAEALDLILRK

SEQ ID NO: 280 - protein, 397 aa, Mycobacterium tuberculosis
MTPSQWLDIAVLAVAFIAAISGWRAGALGSMLSFGGVLLGATAGVLLAPHIVSQISAPRAKLFAALFLILALVVVGEVAGVVLGRAVRGAIRNRPIRLIDSVIGVGVQLVVVLTAAWLLAMPLTQSKEQPELAAAVKGSRVLARVNEAAPTWLKTVPKRLSALLNTSGLPAVLEPFSRTPVIPVASPDPALVNNPVVAATEPSVVKIRSLAPRCQKVLEGTGFVISPDRVMTNAHVVAGSNNVTVYAGDKPFEATVVSYDPSVDVAILAVPHLPPPPLVFAAEPAKTGADVVVLGYPGGGNFTATPARIREAIRLSGPDIYGDPEPVTRDVYTIRADVEQGDSGGPLIDLNGQVLGVVFGAAIDDAETGFVLTAGEVAGQLAKIGATQPVGTGACVS

SEQ ID NO: 281 - protein, 810 aa, Mycobacterium tuberculosis
MPERLPAAITVLKLAGCCLLASVVATALTFPFAGGLGLMSNRASEVVANGSAQLLEGQVPAVSTMVDAKGNTIAWLYSQRRFEVPSDKIANTMKLAIVSIEDKRFADHSGVDWKGTLTGLAGYASGDLDTRGGSTLEQQYVKNYQLLVTAQTDAEKRAAVETTPARKLREIRMALTLDKTFTKSEILTRYLNLVSFGNNSFGVQDAAQTYFGINASDLNWQQAALLAGMVQSTSTLNPYTNPDGALARRNVVLDTMIENLPGEAEALRAAKAEPLGVLPQPNELPRGCIAAGDRAFFCDYVQEYLSRAGISKEQVATGGYLIRTTLDPEVQAPVKAAIDKYASPNLAGISSVMSVIKPGKDAHKVLAMASNRKYGLDLEAGETMRPQPFSLVGDGAGSIFKIFTTAAALDMGMGINAQLDVPPRFQAKGLGSGGAKGCPKETWCVVNAGNYRGSMNVTDALATSPNTAFAKLISQVGVGRAVDMAIKLGLRSYANPGTARDYNPDSNESLADFVKRQNLGSFTLGPIELNALELSNVAATLASGGVWCPPNPIDQLIDRNGNEVAVTTETCDQVVPAGLANTLANAMSKDAVGSGTAAGSAGAAGWDLPMSGKTGTTEAHRSAGFVGFTNRYAAANYIYDDSSSPTDLCSGPLRHCGSGDLYGGNEPSRTWFAAMKPIANNFGEVQLPPTDPRYVDGAPGSRVPSVAGLDVDAARQRLKDAGFQVADQTNSVNSSAKYGEVVGTSPSGQTIPGSIVTIQISNGIPPAPPPPPLPEDGGPPPPVGSQVVEIPGLPPITIPLLAPPPPAPPP

SEQ ID NO: 282 - protein, 578 aa, Mycobacterium tuberculosis
VALYRKYRPASFAEVVGQEHVTAPLSVALDAGRINHAYLFSGPRGCGKTSSARILARSLNCAQGPTANPCGVCESCVSLAPNAPGSIDVVELDAASHGGVDDTRELRDRAFYAPVQSRYRVFIVDEAHMVTTAGFNALLKIVEEPPEHLIFIFATTEPEKVLPTIRSRTHHYPFRLLPPRTMRALLARICEQEGVVVDDAVYPLVIRAGGGSPRDTLSVLDQLLAGAADTHVTYTRALGLLGVTDVALIDDAVDALAACDAAALFGAIESVIDGGHDPRRFATDLLERFRDLIVLQSVPDAASRGVVDAPEDALDRMREQAARIGRATLTRYAEVVQAGLGEMRGATAPRLLLEVVCARLLLPSASDAESALLQRVERIETRLDMSIPAPQAVPRPSAAAAEPKHQPAREPRPVLAPTPASSEPTVAAVRSMWPTVRDKVRLRSRTTEVMLAGATVRALEDNTLVLTHESAPLARRLSEQRNADVLAEALKDALGVNWRVRCETGEPAAAASPVGGGANVATAKAVNPAPTANSTQRDEEEHMLAEAGRGDPSPRRDPEEVALELLQNELGARRIDNA

SEQ ID NO: 283 - protein, 280 aa, Mycobacterium tuberculosis
MTFMDAQASFQTQSRTLARVRGDLVDGFRRHELWLHLGWQDIKQRYRRSVLGPFWITIATGTTAVAMGGLYSKLFRLELSEHLPYVTLGLIVWNLINAAILDGAEVFVANEGLIKQLPAPLSVHVYRLVWRQMIFFAHNIVIYFVIAIIFPKPWSWADLSFLPALALIFLNCVWVSLCFGILATRYRDIGPLLFSVVQLLFFMTPIIWNDETLRRQGAGRWSSIVELNPLLHYLDIVRAPLLGAHQELRHWLVVLVLTVVGWMLAAFAMRQYRARVPYWV

SEQ ID NO: 284 - protein, 121 aa, Mycobacterium tuberculosis
MRFVVTGGLAGIVDFGLYVVLYKVAGLQVDLSKAISFIVGTITAYLINRRWTFQAEPSTARFVAVMLLYGITFAVQVGLNHLCLALLHYRAWAIPVAFVIAQGTATVINFIVQRAVIFRIR

SEQ ID NO: 285 - protein, 461 aa, Mycobacterium tuberculosis [sequence omitted]

SEQ ID NO: 286 - protein, 254 aa, Mycobacterium tuberculosis [sequence omitted]

SEQ ID NO: 287 - protein, 1094 aa, Mycobacterium tuberculosis
VPHDGNERSHRIARLAAVVSGIAGLLLCGIVPLLPVNQTTATIFWPQGSTADGNITQITAPLVSGAPRALDISIPCSAIATLPANGGLVLSTLPAGGVDTGKAGLFVRANQDTVVVAFRDSVAAVAARSTIAAGGCSALHIWADTGGAGADFMGIPGGAGTLPPEKKPQVGGIFTDLKVGAQPGLSARVDIDTRFITTPGALKKAVMLLGVLAVLVAMVGLAALDRLSRGRTLRDWLTRYRPRVRVGFASRLADAAVIATLLLWHVIGATSSDDGYLLTVARVAPKAGYVANYYRYFGTTEAPFDWYTSVLAQLAAVSTAGVWMRLPATLAGIACWLIVSRFVLRRLGPGPGGLASNRVAVFTAGAVFLSAWLPFNNGLRPEPLIALGVLVTWVLVERSIALGRLAPAAVAIIVATLTATLAPQGLIALAPLLTGARAIAQRIRRRRATDGLLAPLAVLAAALSLITVVVFRDQTLATVAESARIKYKVGPTIAWYQDFLRYYFLTVESNVEGSMSRRFAVLVLLFCLFGVLFVLLRRGRVAGLASGPAWRLIGTTAVGLLLLTFTPTKWAVQFGAFAGLAGVLGAVTAFTFARIGLHSRRNLTLYVTALLFVLAWATSGINGWFYVGNYGVPWYDIQPVIASHPVTSMFLTLSILTGLLAAWYHFRMDYAGHTEVKDNRRNRILASTPLLVVAVIMVAGEVGSMAKAAVFRYPLYTTAKANLTALSTGLSSCAMADDVLAEPDPNAGMLQPVPGQAFGPDGPLGGISPVGFKPEGVGEDLKSDPVVSKPGLVNSDASPNKPNAAITDSAGTAGGKGPVGINGSHAALPFGLDPARTPVMGSYGENNLAATATSAWYQLPPRSPDRPLVVVSAAGAIWSYKEDGDFIYGQSLKLQWGVTGPDGRIQPLGQVFPIDIGPQPAWRNLRFPLAWAPPEADVARIVAYDPNLSPEQWFAFTPPRVPVLESLQRLIGSATPVLMDIATAANFPCQRPFSEHLGIAELPQYRILPDHKQTAASSNLWQSSSTGGPFLFTQALLRTSTIATYLRGDWYRDWGSVEQYHRLVPADQAPDAVVEEGVITVPGWGRPGPIRALP

SEQ ID NO: 288 - protein, 1098 aa, Mycobacterium tuberculosis
MTQCASRRKSTPNRAILGAFASARGTRWVATIAGLIGFVLSVATPLLPVVQTTAMLDWPQRGQLGSVTAPLISLTPVDFTATVPCDVVRAMPPAGGVVLGTAPKQGKDANLQALFVVVSAQRVDVTDRNVVILSVPREQVTSPQCQRIEVTSTHAGTFANFVGLKDPSGAPLRSGFPDPNLRPQIVGVFTDLTGPAPPGLAVSATIDTRFSTRPTTLKLLAIIGAIVATVVALIALWRLDQLDGRGSIAQLLLRPFRPASSPGGMRRLIPASWRTFTLTDAVVIFGFLLWHVIGANSSDDGYILGMARVADHAGYMSNYFRWFGSPEDPFGWYYNLLALMTHVSDASLWMRLPDLAAGLVCWLLLSREVLPRLGPAVEASKPAYWAAAMVLLTAWMPFNNGLRPEGIIALGSLVTYVLIERSMRYSRLTPAALAVVTAAFTLGVQPTGLIAVAALVAGGRPMLRILVRRHRLVGTLPLVSPMLAAGTVILTVVFADQTLSTVLEATRVRAKIGPSQAWYTENLRYYYLILPTVDGSLSRRFGFLITALCLFTAVFIMLRRKRIPSVARGPAWRLMGVIFGTMFFLMFTPTKWVHHFGLFAAVGAAMAALTTVLVSPSVLRWSRNRMAFLAALFFLLALCWATTNGWWYVSSYGVPFNSAMPKIDGITVSTIFFALFAIAAGYAAWLHFAPRGAGEGRLIRALTTAPVPIVAGFMAAVFVASMVAGIVRQYPTYSNGWSNVRAFVGGCGLADDVLVEPDTNAGFMKPLDGDSGSWGPLGPLGGVNPVGFTPNGVPEHTVAEAIVMKPNQPGTDYDWDAPTKLTSPGINGSTVPLPYGLDPARVPLAGTYTTGAQQQSTLVSAWYLLPKPDDGHPLVVVTAAGKIAGNSVLHGYTPGQTVVLEYAMPGPGALVPAGRMVPDDLYGEQPKAWRNLRFARAKMPADAVAVRVVAEDLSLTPEDWIAVTPPRVPDLRSLQEYVGSTQPVLLDWAVGLAFPCQQPMLHANGIAEIPKFRITPDYSAKKLDTDTWEDGTNGGLLGITDLLLRAHVMATYLSRDWARDWGSLRKFDTLVDAPPAQLELGTATRSGLWSPGKIRIGP

SEQ ID NO: 289 - protein, 419 aa, Mycobacterium tuberculosis
VIDLKLLRENPDAVRRSQLSRGEDPALVDALLTADAARRAVISTADSLRAEQKAASKSVGGASPEERPPLLRRAKELAEQVKAAEADEVEAEAAFTAAHLAISNVIVDGVPAGGEDDYAVLDVVGEPSYLENPKDHLELGESLGLIDMQRGAKVSGSRFYFLTGRGALLQLGLLQLALKLAVDNGFVPTIPPVLVRPEVMVGTGFLGAHAEEVYRVEGDGLYLVGTSEVPLAGYHSGEILDLSRGPLRYAGWSSCFRREAGSHGKDTRGIIRVHQFDKVEGFVYCTPADAEHEHERLLGWQRQMLARIEVPYRVIDVAAGDLGSSAARKFDCEAWIPTQGAYRELTSTSNCTTFQARRLATRYRDASGKPQIAATLNGTLATTRWLVAILENHQRPDGSVRVPDALVPFVGVEVLEPVA

SEQ ID NO: 290 - protein, 480 aa, Mycobacterium tuberculosis
VPEAVQEADLLTAAAVALNRHAALLRELGSVFAAAGHELYLVGGSVRDALLGRLSPDLDFTTDARPERVQEIVRPWADAVWDTGIEFGTVGVGKSDHRMEITTFRADSYDRVSRHPEVRFGDCLEGDLVRRDFTTNAMAVRVTATGPGEFLDPLGGLAALRAKVLDTPAAPSGSFGDDPLRMLRAARFVSQLGFAVAPRVRAAIEEMAPQLARISAERVAAELDKLLVGEDPAAGIDLMVQSGMGAVVLPEIGGMRMAIDEHHQHKDVYQHSLTVLRQAIALEDDGPDLVLRWAALLHDIGKPATRRHEPDGGVSFHHHEVVGAKMVRKRMRALKYSKQMIDDISQLVYLHLRFHGYGDGKWTDSAVRRYVTDAGALLPRLHKLVRADCTTRNKRRAARLQASYDRLEERIAELAAQEDLDRVRPDLDGNQIMAVLDIPAGPQVGEAWRYLKELRLERGPLSTEEATTELLSWWKSRGNR

SEQ ID NO: 291 - protein, 133 aa, Mycobacterium tuberculosis
MADRIELRGLTVHGRHGVYDHERVAGQRFVIDVTVWIDLAEAANSDDLADTYDYVRLASRAAEIVAGPPRKLIETVGAEIADHVMDDQRVHAVEVAVHKPQAPIPQTFDDVAVVIRRSRRGGRGWVVPAGGAV

SEQ ID NO: 292 - protein, 760 aa, Mycobacterium tuberculosis
MNRKNVTRTITAIAVVVLLGWSFFYFSDDTRGYKPVDTSVAITQINGDNVKSAQIDDREQQLRLILKKGNNETDGSEKVITKYPTGYAVDLFNALSAKNAKVSTVVNQGSILGELLVYVLPLLLLVGLFVMFSRMQGGARMGFGFGKSRAKQLSKDMPKTTFADVAGVDEAVEELYEIKDFLQNPSRYQALGAKIPKGVLLYGPPGTGKTLLARAVAGEAGVPFFTISGSDFVEMFVGVGASRVRDLFEQAKQNSPCIIFVDEIDAVGRQRGAGLGGGHDEREQTLNQLLVEMDGFGDRAGVILIAATNRPDILDPALLRPGRFDRQIPVSNPDLAGRRAVLRVHSKGKPMAADADLDGLAKRTVGMTGADLANVINEAALLTARENGTVITGPALEEAVDRVIGGPRRKGRIISEQEKKITAYHEGGHTLAAWAMPDIEPIYKVTILARGRTGGHAVAVPEEDKGLRTRSEMIAQLVFAMGGRAAEELVFREPTTGAVSDIEQATKIARSMVTEFGMSSKLGAVKYGSEHGDPFLGRTMGTQPDYSHEVAREIDEEVRKLIEAAHTEAWEILTEYRDVLDTLAGELLEKETLHRPELESIFADVEKRPRLTMFDDFGGRIPSDKPPIKTPGELAIERGEPWPQPVPEPAFKAAIAQATQAAEAARSDAGQTGHGANGSPAGTHRSGDRQYGSTQPDYGAPAGWHAPGWPPRSSHRPSYSGEPAPTYPGQPYPTGQADPGSDESSAEQDDEVSRTKPAHG

What is claimed is:

1. A method for identifying a second nucleic acid sequence or second polypeptide sequence of a second protein, wherein the second protein has a biological or chemical property of interest, comprising:

(a) providing a first nucleic acid sequence that encodes a first protein, or a first polypeptide sequence of the first protein, wherein the first protein has a biological or chemical property of interest;

(b) providing an algorithm capable of analyzing a functional relationship between the first protein and second protein, wherein the algorithm is a "phylogenetic profile" method, wherein the "phylogenetic profile" method algorithm comprises (i) obtaining data comprising a plurality of sequences, wherein the plurality of sequences comprises a list of polypeptide sequences of proteins from at least two genomes or a list of nucleic acid sequences that encode proteins from at least two genomes;

(ii) determining a protein phylogenetic profile for the first protein and for each protein of the plurality of sequences, wherein the protein phylogenetic profile indicates the presence or absence of a protein belonging to a particular protein family in each of the at least two genomes wherein the presence or absence of a protein in a particular protein family is determined by homology, wherein the homology between proteins is considered significant if a probability (p) of obtaining a higher homology score when the sequences are shuffled is below a probability (p) value threshold and wherein the probability (p) value threshold is set with respect to the value 1/NM, based on the total number of sequence comparisons that are to be performed, wherein N is the number of proteins in the first organism's genome and M is the number of proteins in all other genomes;

(iii) grouping the proteins of the plurality of sequences based on similar profiles, wherein proteins with similar profiles are indicated to have a functional relationship; and (iv) comparing the first nucleic acid sequence or the first polypeptide sequence to the plurality of sequences by comparing the protein phylogenetic profile for the first protein to the protein phylogenetic profiles of the plurality of sequences to identify the second protein, whereby the second protein is selected from the members of the group with similar profiles as the first protein; and (c) comparing the first nucleic acid sequence or the first polypeptide sequence to a plurality of sequences using the algorithm as set forth in step (b) to identify the second nucleic acid sequence or second polypeptide sequence of the second protein which has a functional relationship to the first protein; thereby identifying a second nucleic acid sequence or a second polypeptide sequence of a second protein that possesses the property of interest.

2. A method for identifying a second nucleic acid sequence or second polypeptide sequence of a second protein, wherein the second protein has a biological or chemical property of interest, comprising:

(a) providing a first nucleic acid sequence that encodes a first protein, or a first polypeptide sequence of the first protein, wherein the first protein has a biological or chemical property of interest;

(b) providing an algorithm capable of analyzing a functional relationship between the first protein and second protein, wherein the algorithm is a "phylogenetic profile" method, wherein the "phylogenetic profile" method algorithm comprises (i) obtaining data comprising a plurality of sequences, wherein the plurality of sequences comprises a list of polypeptide sequences of proteins from at least two genomes or a list of nucleic acid sequences that encode proteins from at least two genomes;

(ii) determining a protein phylogenetic profile for the first protein and for each protein of the plurality of sequences, wherein the protein phylogenetic profile indicates the presence or absence of a protein belonging to a particular protein family in each of the at least two genomes wherein the presence or absence of a protein in a particular protein family is determined by calculating an evolutionary distance by:

(A) aligning two sequences from the list of proteins;

(B) determining an evolution probability process by constructing a conditional probability matrix: p(aa→aa'), where aa and aa' are any amino acids, said conditional probability matrix being constructed by converting an amino acid substitution matrix from a log odds matrix to said conditional probability matrix;

(C) accounting for an observed alignment of the constructed conditional probability matrix by taking the product of the conditional probabilities for each aligned pair during the alignment of the two sequences, represented by $$P(p) = \prod_n p(aa_n \rightarrow aa'_n);$$

and (D) determining an evolutionary distance a from powers equation $p'=p^{60}$ (aa→aa'), maximizing for P;

(iii) grouping the proteins of the plurality of sequences based on similar profiles, wherein proteins with similar profiles are indicated to have a functional relationship; and (iv) comparing the first nucleic acid sequence or the first polypeptide sequence to the plurality of sequences by comparing the protein phylogenetic profile for the first protein to the protein phylogenetic profiles of the plurality of sequences to identify the second protein whereby the second protein is selected from the members of the group with similar profiles as the first protein; and (c) comparing the first nucleic acid sequence or the first polypeptide sequence to a plurality of sequences using at least one of the algorithms as set forth in step (b) to identify the second nucleic acid sequence or second polypeptide sequence of the second protein which has a functional relationship to the first protein, thereby identifying a second nucleic acid sequence or a second polypeptide sequence of a second protein that possesses the property of interest.

3. The method of claim 2, wherein the conditional probability matrix is defined by a Markov process with substitution rates, over a fixed time interval.

4. The method of claim 2, where the conversion from an amino acid substitution matrix to a conditional probability matrix is represented by:

$$P_B(i \rightarrow j) = p(j)2 \wedge \frac{BLOSUM62_{ij}}{2},$$

where BLOSUM62 is an amino acid substitution matrix, and P(i→j) is the probability that amino acid i is replaced by amino acid j through point mutations according to BLOSUM62 scores.

5. The method of claim 4, where Pj's are the abundances of amino acid j and are computed by solving a plurality of linear equations given by the normalization condition that:

$$\sum_i P_B(i \rightarrow j) = 1.$$

6. A method for identifying a second nucleic acid sequence or second polypeptide sequence of a second protein, wherein the second protein has a biological or chemical property of interest, comprising:

(a) providing a first nucleic acid sequence that encodes a first protein, or a first polypeptide sequence of the first protein, wherein the first protein has a biological or chemical property of interest;

(b) providing an algorithm capable of analyzing a functional relationship between the first protein and second protein, wherein the algorithm is "domain fusion" method; and (c) comparing the first nucleic acid sequence or the first polypeptide sequence to a plurality of sequences using the algorithm as set forth in step (b) to identify the second nucleic acid sequence or second polypeptide sequence of the second protein which has a functional relationship to the first protein, thereby identifying a second nucleic acid sequence or a second polypeptide sequence of a second protein that possesses the property of interest.

7. The method of claim 6, wherein the property of interest is a binding or catalytic site or cellular localization.

8. The method of claim 6, wherein the property of interest is a target for a drug.

9. The method of claim 6, wherein the property of interest is that of being essential for the growth or viability of an organism.

10. The method of claim 8, wherein the drug is an anti-microbial drug.

11. The method of claim 8 or claim 9, wherein the first nucleic acid sequence or polypeptide sequence is derived from a pathogen.

12. The method of claim 11, wherein the pathogen is a microorganism.

13. The method of claim 12, wherein the microorganism is *Mycobacterium tuberculosis* (MTB).

14. The method of claim 8 or claim 9, wherein the plurality of sequences used to identify a second sequence comprises a database of the gene sequences of an entire genome of an organism.

15. The method of claim 8 or claim 9, wherein the plurality of sequences used to identify a second sequence comprises a database of the gene sequences derived from a pathogen.

16. The method of claim 8 or 9, wherein the "domain fusion" method comprises:

(a) providing a pair of non-homologous nucleic acid or polypeptide sequences of the first and second proteins, respectively;

(b) providing a third nucleic acid or polypeptide sequence of a third protein;

(c) aligning the sequences of the first and second proteins in step (a) to a segment of the sequence in step (b); and (d) establishing whether the first and second proteins in step (a) are homologues to the segments of the sequence in step (b) as aligned in step (c), wherein identification of homology between the sequences of the first and third protein and the second and third protein identifies the first and second proteins as having a functional relationship.

17. The method of claim 16, wherein the aligning is performed by an algorithm selected from the group consisting of a Smith-Waterman algorithm, Needleman-Wunsch algorithm, a BLAST algorithm, a FASTA algorithm, and a PSI-BLAST algorithm.

18. The method of claim 16, wherein at least one polypeptide sequence is obtained by translating a nucleic acid sequence from a genome database.

19. The method of claim 16, wherein the polypeptide or nucleic acid sequences of at least the first, second or third protein are from a database.

20. The method of claim 16, wherein at least the first protein has a known function.

21. The method of claim 16, wherein at least one of the proteins has an unknown function.

22. The method of claim 16, wherein the alignment is based on the degree of homology of the nucleic acid or polypeptide sequences of the first and second proteins to a segment of the nucleic acid or polypeptide sequence of the third protein.

23. The method of claim 16, wherein the homology between the sequences of the first and third protein and the second and third protein is considered significant if the probability (p) of obtaining a higher homology score when the sequences are shuffled is below a probability (p) value threshold.

24. The method of claim 23, wherein the probability (p) value threshold is set with respect to the value 1/NM, based on the total number of sequence comparisons that are to be performed, wherein N is the number of proteins in a first organism's genome and M is the number of proteins in all other genomes.

25. The method of claim 16, further comprising filtering excessive functional links between the first protein and any second protein.

26. The method of claim 5 or claim 2, wherein the property of interest is a target for a drug.

27. The method of claim 26, wherein the drug is an anti-microbial drug.

28. The method of claim 1 or claim 2, wherein the property of interest is that of being essential for the growth or viability of an organism.

29. The method of claim 1 or claim 2, wherein the first nucleic acid sequence or polypeptide is derived from a pathogen.

30. The method of claim 29, wherein the pathogen is a microorganism.

31. The method of claim 30, wherein the microorganism is *Mycobacterium tuberculosis* (MTB).

* * * * *